US012297253B2

(12) United States Patent
Swanson

(10) Patent No.: US 12,297,253 B2
(45) Date of Patent: May 13, 2025

(54) MULTI-DOMAIN IMMUNOMODULATORY PROTEINS AND METHODS OF USE THEREOF

(71) Applicant: Alpine Immune Sciences, Inc., Seattle, WA (US)

(72) Inventor: Ryan Swanson, Seattle, WA (US)

(73) Assignee: Alpine Immune Sciences, Inc., Seattle, WA (US)

(*) Notice: Subject to any disclaimer, the term of this patent is extended or adjusted under 35 U.S.C. 154(b) by 1158 days.

(21) Appl. No.: 16/959,662

(22) PCT Filed: Jan. 3, 2019

(86) PCT No.: PCT/US2019/012222

§ 371 (c)(1),
(2) Date: Jul. 1, 2020

(87) PCT Pub. No.: WO2019/136179

PCT Pub. Date: Jul. 11, 2019

(65) Prior Publication Data

US 2023/0101432 A1 Mar. 30, 2023

Related U.S. Application Data

(60) Provisional application No. 62/733,622, filed on Sep. 19, 2018, provisional application No. 62/613,378, filed on Jan. 3, 2018.

(51) Int. Cl.

| | |
|---|---|
| ***C07K 14/705*** | (2006.01) |
| ***A61K 39/395*** | (2006.01) |
| ***A61P 37/02*** | (2006.01) |
| ***C07K 16/28*** | (2006.01) |
| ***C07K 16/46*** | (2006.01) |

(52) U.S. Cl.
CPC .... *C07K 14/70532* (2013.01); *C07K 16/2896* (2013.01); *C07K 16/461* (2013.01); *C07K 2319/30* (2013.01)

(58) Field of Classification Search
None
See application file for complete search history.

(56) References Cited

U.S. PATENT DOCUMENTS

| | | | |
|---|---|---|---|
| 4,751,180 | A | 6/1988 | Cousens |
| 4,935,233 | A | 6/1990 | Bell et al. |
| 5,168,062 | A | 12/1992 | Stinski |
| 5,208,020 | A | 5/1993 | Chari et al. |
| 5,283,173 | A | 2/1994 | Fields et al. |
| 5,385,839 | A | 1/1995 | Stinski |
| 5,434,131 | A | 7/1995 | Linsley et al. |
| 5,443,964 | A | 8/1995 | Pickup et al. |
| 5,457,035 | A | 10/1995 | Baum et al. |
| 5,468,614 | A | 11/1995 | Fields et al. |
| 5,500,362 | A | 3/1996 | Robinson et al. |
| 5,624,821 | A | 4/1997 | Winter et al. |
| 5,641,870 | A | 6/1997 | Rinderknecht et al. |
| 5,648,260 | A | 7/1997 | Winter et al. |
| 5,698,530 | A | 12/1997 | Schlom et al. |
| 5,716,613 | A | 2/1998 | Guber et al. |
| 5,731,168 | A | 3/1998 | Carter et al. |
| 5,767,071 | A | 6/1998 | Palladino et al. |
| 5,773,253 | A | 6/1998 | Linsley et al. |
| 5,780,426 | A | 7/1998 | Palladino et al. |
| 5,821,337 | A | 10/1998 | Carter et al. |
| 5,844,095 | A | 12/1998 | Linsley et al. |
| 5,851,529 | A | 12/1998 | Guber et al. |
| 5,851,795 | A | 12/1998 | Linsley et al. |
| 5,885,579 | A | 3/1999 | Linsley et al. |
| 5,885,796 | A | 3/1999 | Linsley et al. |
| 5,891,432 | A | 4/1999 | Hoo |
| 5,998,205 | A | 12/1999 | Hallenbeck et al. |
| 6,143,290 | A | 11/2000 | Zhang et al. |
| 6,194,551 | B1 | 2/2001 | Idusogie et al. |
| 6,365,619 | B1 | 4/2002 | Shi |
| 6,428,968 | B1 | 8/2002 | Molnar-Kimber et al. |
| 6,444,792 | B1 | 9/2002 | Gray et al. |
| 6,482,919 | B2 | 11/2002 | Ledbetter et al. |

(Continued)

FOREIGN PATENT DOCUMENTS

| | | | |
|---|---|---|---|
| CN | 1441810 | A | 9/2003 |
| CN | 103987405 | A | 8/2014 |

(Continued)

OTHER PUBLICATIONS

U.S. Appl. No. 18/355,539, filed Jul. 20, 2023, Evans; Lawrence.*
Butte et al. (2008) Interaction of human PD-L1 and B7-1. Molecular Immunology, 45: 3567-3572.*
Chaudhri et al. (2018) PD-L1 Binds to B7-1 Only in Cis on the Same Cell Surface. Cancer Immunol Res; 6(8); 921-929.*
Australian Examination Report for Application No. 2018236224, dated Jan. 6, 2023, 5 pages.
Benson et al., "GenBank," Nucleic Acids Res (2013) 41 (Database issue):D36-D42.
Biasini et al., "Swiss-Model: modelling protein tertiary and quaternary structure using evolutionary information," Nucleic Acids Research, Jul. 2014, 42(W1), pp. W252-W258.
Brandt et al., "The B7 family member B7-H6 is a tumor cell ligand for the activating natural killer cell receptor NKp30 in humans," Journal of Experimental Medicine, Jul. 2009, 206(7), pp. 1495-1503.

(Continued)

*Primary Examiner* — Ilia I Ouspenski
(74) *Attorney, Agent, or Firm* — MARSHALL, GERSTEIN & BORUN LLP

(57) ABSTRACT

Provided herein are multi-domain immunomodulatory proteins, nucleic acids encoding such immunomodulatory proteins, cells engineered to express the immunomodulatory proteins and infectious agents containing nucleic acid encoding the immunomodulatory proteins. The immunomodulatory proteins bind both an inhibitory receptor and a receptor involved in activation signaling cascades in an immune cell, such as a T cell. The immunomodulatory proteins, engineered cells and infectious agents provide therapeutic utility for a variety of immunological diseases or conditions. Compositions and methods for making and using such proteins are provided.

37 Claims, 37 Drawing Sheets

Specification includes a Sequence Listing.

(56) References Cited

U.S. PATENT DOCUMENTS 6,596,535 B1 7/2003 Carter
6,623,940 B1 9/2003 Ledbetter et al.
6,632,670 B1 10/2003 Wadsworth et al.
6,635,472 B1 10/2003 Lauermann
6,653,103 B2 11/2003 Petersen et al.
6,685,941 B1 2/2004 Thompson et al.
6,689,871 B1 2/2004 Wolfe et al.
6,723,316 B2 4/2004 Laquerre et al.
6,737,056 B1 5/2004 Presta
6,750,334 B1 6/2004 Gray et al.
6,855,317 B2 2/2005 Koelle et al.
6,887,471 B1 5/2005 Linsley et al.
6,897,045 B2 5/2005 Engelhardt et al.
6,936,257 B1 8/2005 Bennett
6,998,252 B1 2/2006 Moss et al.
7,001,765 B2 2/2006 Maass et al.
7,033,826 B2 4/2006 Perricaudet et al.
7,094,874 B2 8/2006 Peach et al.
7,094,875 B2 8/2006 Punnonen et al.
7,105,166 B1 9/2006 Linsley et al.
7,125,717 B2 10/2006 Carter
7,153,510 B1 12/2006 Rose
7,172,893 B2 2/2007 Rabinowitz et al.
7,238,526 B2 7/2007 Wilson et al.
7,241,447 B1 7/2007 Engelhardt et al.
7,247,615 B2 7/2007 Schlom et al.
7,304,033 B2 12/2007 Larsen et al.
7,307,064 B2 12/2007 Rusnak
7,332,303 B2 2/2008 Schilling et al.
7,332,581 B2 2/2008 Presta
7,368,116 B2 5/2008 Schlom et al.
7,371,826 B2 5/2008 Presta
7,378,087 B2 5/2008 Jefferies et al.
7,439,230 B2 10/2008 Peach et al.
7,455,835 B2 11/2008 Cohen et al.
7,482,327 B2 1/2009 Hagerty et al.
7,521,532 B2 4/2009 Dunussi-Joannopoulos et al.
7,537,924 B2 5/2009 Coffin
7,550,296 B2 6/2009 Hermiston et al.
7,563,869 B2 7/2009 Honjo et al.
7,569,663 B2 8/2009 Tykocinski et al.
7,588,767 B2 9/2009 Szalay et al.
7,588,771 B2 9/2009 Szalay et al.
7,655,439 B2 2/2010 Moore et al.
7,662,398 B2 2/2010 Szalay et al.
7,662,627 B2 2/2010 Johnson, Jr.
7,670,602 B2 3/2010 Chung et al.
7,671,022 B2 3/2010 Rusnak
7,700,556 B2 4/2010 Peach et al.
7,722,868 B2 5/2010 Freeman et al.
7,731,952 B2 6/2010 Mohr et al.
7,731,974 B2 6/2010 Bell et al.
7,754,221 B2 7/2010 Szalay et al.
7,794,718 B2 9/2010 Karrer et al.
7,811,814 B2 10/2010 Bohn et al.
7,829,534 B2 11/2010 Larsen et al.
7,897,146 B2 3/2011 Brown et al.
7,906,111 B2 3/2011 Wilson et al.
7,915,222 B2 3/2011 Vratsanos et al.
7,915,395 B2 3/2011 Ledbetter et al.
7,927,585 B2 4/2011 Snyder
7,943,374 B2 5/2011 Hildinger
7,968,340 B2 6/2011 Hallek et al.
8,007,780 B2 8/2011 Arbetman et al.
8,071,095 B2 12/2011 Karrer et al.
8,088,736 B2 1/2012 Franks et al.
8,148,332 B2 4/2012 Cohen et al.
8,227,420 B2 7/2012 Cohen et al.
8,268,587 B2 9/2012 Karrer et al.
8,283,447 B2 10/2012 Karrer et al.
8,318,176 B2 11/2012 Karrer et al.
8,329,867 B2 12/2012 Lazar et al.
8,435,952 B2 5/2013 Vratsanos et al.
8,445,230 B2 5/2013 Karrer et al.
8,445,447 B2 5/2013 Chen
8,491,899 B2 7/2013 Karrer et al.
8,496,935 B2 7/2013 Karrer et al.
8,497,247 B2 7/2013 Cohen et al.
8,609,625 B2 12/2013 Lan et al.
8,624,010 B1 1/2014 Yoshinaga
8,629,119 B2 1/2014 Olson et al.
8,642,557 B2 2/2014 Akamatsu et al.
8,703,718 B2 4/2014 Cohen et al.
8,709,417 B2 4/2014 Allison et al.
8,722,632 B2 5/2014 Cohen et al.
8,785,398 B2 7/2014 Peach et al.
8,883,971 B2 11/2014 Akamatsu et al.
8,911,726 B2 12/2014 Takahashi et al.
8,956,619 B2 2/2015 Ostrand-Rosenberg
9,012,408 B2 4/2015 Vratsanos et al.
9,103,831 B2 8/2015 O'Sullivan et al.
9,289,480 B2 3/2016 Lan et al.
9,296,808 B2 3/2016 Cohen et al.
9,327,014 B2 5/2016 Gurney et al.
9,375,475 B2 6/2016 Allison et al.
9,453,227 B2 9/2016 Diamond et al.
9,540,426 B2 1/2017 Jing et al.
9,587,007 B2 3/2017 Akamatsu et al.
9,709,568 B2 7/2017 Pierce et al.
9,758,565 B2 9/2017 Peach et al.
9,834,604 B2 12/2017 Zhu et al.
9,884,902 B2 2/2018 Minter et al.
10,487,147 B2 11/2019 Nastri et al.
10,882,914 B2 1/2021 Swanson et al.
11,078,282 B2 * 8/2021 Swanson ................. A61P 19/02
11,096,988 B2 8/2021 Swanson et al.
11,117,948 B2 9/2021 Swanson et al.
11,117,949 B2 9/2021 Swanson et al.
11,117,950 B2 9/2021 Swanson et al.
11,319,359 B2 * 5/2022 Swanson .......... G01N 33/57484
11,753,458 B2 * 9/2023 Evans .............. C07K 14/70521
424/93.21
2002/0009454 A1 1/2002 Boone et al.
2002/0168714 A1 11/2002 Barbas et al.
2003/0083246 A1 5/2003 Cohen et al.
2003/0138881 A1 7/2003 Punnonen et al.
2003/0158102 A1 8/2003 Chen et al.
2003/0232323 A1 * 12/2003 Freeman .............. G01N 33/505
435/4
2004/0009604 A1 1/2004 Zhang et al.
2004/0063094 A1 4/2004 Coffin et al.
2004/0072283 A1 4/2004 Seed et al.
2004/0146488 A1 7/2004 Hu et al.
2005/0014934 A1 1/2005 Hinton et al.
2005/0220818 A1 10/2005 Lorence
2005/0260601 A1 11/2005 Whitt et al.
2006/0024298 A1 2/2006 Lazar et al.
2006/0039894 A1 2/2006 Mohr et al.
2007/0098743 A1 5/2007 Bell et al.
2007/0110720 A1 5/2007 Brown et al.
2007/0202572 A1 8/2007 Szalay et al.
2007/0212727 A1 9/2007 Szalay et al.
2009/0010889 A1 1/2009 Brown et al.
2009/0053244 A1 2/2009 Chen et al.
2009/0098529 A1 4/2009 Chen et al.
2009/0117034 A1 5/2009 Chen et al.
2009/0136917 A1 5/2009 Szalay et al.
2009/0155287 A1 6/2009 Chen et al.
2009/0162288 A1 6/2009 Chen et al.
2009/0215147 A1 8/2009 Zhang et al.
2009/0252749 A1 10/2009 Leister et al.
2009/0258031 A1 10/2009 Karrer et al.
2009/0274728 A1 11/2009 Brown et al.
2009/0285860 A1 11/2009 Martuza et al.
2010/0062016 A1 3/2010 Szalay et al.
2010/0092515 A1 4/2010 Conner et al.
2010/0113567 A1 5/2010 Barber
2010/0178276 A1 7/2010 Sadelain et al.
2010/0178684 A1 7/2010 Woo et al.
2010/0196325 A1 8/2010 Szalay et al.
2010/0233078 A1 9/2010 Szalay et al.
2010/0261660 A1 10/2010 Punnonen et al.
2011/0064650 A1 3/2011 Szalay
2011/0064763 A1 3/2011 Allen et al.

(56) References Cited

U.S. PATENT DOCUMENTS

| | | | |
|---|---|---|---|
| 2011/0158948 | A1 | 6/2011 | Brown et al. |
| 2011/0159023 | A1 | 6/2011 | Langermann |
| 2011/0177032 | A1 | 7/2011 | Martuza et al. |
| 2011/0195068 | A1 | 8/2011 | Langermann et al. |
| 2011/0212530 | A1 | 9/2011 | Baltimore et al. |
| 2011/0293705 | A1 | 12/2011 | Irvine et al. |
| 2011/0305712 | A1* | 12/2011 | Akamatsu ........ C07K 14/70521 435/254.2 |
| 2013/0149305 | A1 | 6/2013 | Ostrand-Rosenberg |
| 2013/0287748 | A1 | 10/2013 | June et al. |
| 2013/0319861 | A1 | 12/2013 | Khandros et al. |
| 2014/0011370 | A1 | 1/2014 | Camphausen |
| 2014/0050708 | A1 | 2/2014 | Powell et al. |
| 2014/0056890 | A1 | 2/2014 | Gurney et al. |
| 2014/0099309 | A1 | 4/2014 | Powell, Jr. et al. |
| 2014/0154216 | A1 | 6/2014 | Coffin |
| 2014/0186380 | A1 | 7/2014 | Gurney |
| 2014/0186401 | A1 | 7/2014 | Diamond et al. |
| 2014/0227237 | A1 | 8/2014 | June et al. |
| 2014/0322129 | A1 | 10/2014 | Leong et al. |
| 2014/0348832 | A1 | 11/2014 | Zhu et al. |
| 2015/0104451 | A1 | 4/2015 | Orban |
| 2015/0216970 | A1 | 8/2015 | Grogan et al. |
| 2015/0232532 | A1 | 8/2015 | Ostrand-Rosenberg |
| 2015/0359909 | A1 | 12/2015 | O'Sullivan et al. |
| 2016/0017018 | A1 | 1/2016 | Wang et al. |
| 2016/0017041 | A1 | 1/2016 | Violette et al. |
| 2016/0145344 | A1 | 5/2016 | Akbari |
| 2016/0158318 | A1 | 6/2016 | Cohen et al. |
| 2016/0244524 | A1 | 8/2016 | Allison et al. |
| 2016/0264643 | A1 | 9/2016 | Lazar et al. |
| 2016/0271218 | A1 | 9/2016 | Biro |
| 2016/0339066 | A1 | 11/2016 | Szalay et al. |
| 2016/0340422 | A1 | 11/2016 | Chen et al. |
| 2016/0346368 | A1 | 12/2016 | Gurney et al. |
| 2016/0376346 | A1 | 12/2016 | Camphausen |
| 2017/0028040 | A1 | 2/2017 | Lan et al. |
| 2017/0042972 | A1 | 2/2017 | Karyekar |
| 2017/0081387 | A1 | 3/2017 | Cai et al. |
| 2017/0189476 | A1 | 7/2017 | Sung et al. |
| 2017/0320959 | A1 | 11/2017 | Swanson et al. |
| 2017/0369549 | A1 | 12/2017 | Peach et al. |
| 2018/0118805 | A1 | 5/2018 | Bernett et al. |
| 2018/0244749 | A1 | 8/2018 | Swanson et al. |
| 2018/0256644 | A1 | 9/2018 | Swanson et al. |
| 2018/0319861 | A1* | 11/2018 | Lan .................. C07K 14/70596 |
| 2019/0135922 | A1 | 5/2019 | Swanson et al. |
| 2019/0175654 | A1* | 6/2019 | Swanson ................ A61K 35/76 |
| 2020/0040059 | A1 | 2/2020 | Swanson et al. |
| 2020/0283500 | A1 | 9/2020 | Lawrence et al. |
| 2020/0308249 | A1 | 10/2020 | Lawrence et al. |
| 2021/0130436 | A1 | 5/2021 | Swanson et al. |
| 2021/0130437 | A1 | 5/2021 | Swanson et al. |
| 2021/0155668 | A1 | 5/2021 | Swanson et al. |
| 2021/0155669 | A1 | 5/2021 | Swanson et al. |
| 2021/0163571 | A1 | 6/2021 | Swanson et al. |
| 2021/0171603 | A1 | 6/2021 | Swanson et al. |
| 2021/0188942 | A1 | 6/2021 | Swanson et al. |
| 2021/0253668 | A1 | 8/2021 | Swanson et al. |
| 2021/0347897 | A1 | 11/2021 | Swanson et al. |
| 2021/0363219 | A1 | 11/2021 | Swanson et al. |
| 2022/0242930 | A1* | 8/2022 | Swanson .......... C07K 14/70521 |
| 2022/0372106 | A1 | 11/2022 | Swanson et al. |
| 2023/0220039 | A1 | 7/2023 | Swanson et al. |
| 2023/0250152 | A1* | 8/2023 | Evans .................... C12N 15/00 424/93.21 |

FOREIGN PATENT DOCUMENTS

| | | | |
|---|---|---|---|
| CN | 105579471 | A | 5/2016 |
| EP | 0757099 | | 2/1997 |
| EP | 1248802 | A2 | 10/2002 |
| EP | 1385466 | A2 | 2/2004 |
| EP | 1391213 | A1 | 2/2004 |
| EP | 1520175 | A2 | 4/2005 |
| EP | 1606411 | A1 | 12/2005 |
| EP | 3020816 | A1 | 5/2016 |
| KR | 20150135148 | | 12/2015 |
| WO | WO-1993/010151 | | 5/1993 |
| WO | WO-1994/011026 | | 5/1994 |
| WO | WO-9411026 | A2 | 5/1994 |
| WO | WO-1994/029351 | | 12/1994 |
| WO | WO-1998/050431 | | 11/1998 |
| WO | WO-1999/002711 | | 1/1999 |
| WO | WO-1999/038955 | | 8/1999 |
| WO | WO-1999/051642 | | 10/1999 |
| WO | WO-2000/042072 | | 7/2000 |
| WO | WO-2001/030843 | | 5/2001 |
| WO | WO-2001/092337 | | 12/2001 |
| WO | WO-2002/000717 | | 1/2002 |
| WO | WO-2004/029197 | | 4/2004 |
| WO | WO-2004/056312 | | 7/2004 |
| WO | WO-2005/063816 | | 7/2005 |
| WO | WO-2005/100402 | | 10/2005 |
| WO | WO-2006/019447 | | 2/2006 |
| WO | WO-2006/029879 | | 3/2006 |
| WO | WO-2006073941 | A2 | 7/2006 |
| WO | WO-2007/029879 | | 3/2007 |
| WO | WO-2007/052029 | | 5/2007 |
| WO | WO-2008011636 | A2 | 1/2008 |
| WO | WO-2008/047150 | | 4/2008 |
| WO | WO-2008/092117 | | 7/2008 |
| WO | WO-2008/155134 | | 12/2008 |
| WO | WO-2009/029342 | | 3/2009 |
| WO | WO-2009/076524 | | 6/2009 |
| WO | WO-2009067800 | A1 | 6/2009 |
| WO | WO-2009/126688 | | 10/2009 |
| WO | WO-2010/027827 | | 3/2010 |
| WO | WO-2010027828 | A2 | 3/2010 |
| WO | WO-2011/020024 | | 2/2011 |
| WO | WO-2011056983 | A1 | 5/2011 |
| WO | WO-2011/097477 | | 8/2011 |
| WO | WO-2011103584 | A2 | 8/2011 |
| WO | WO-2011/113019 | | 9/2011 |
| WO | WO-2011109789 | A2 | 9/2011 |
| WO | WO-2011133886 | A2 | 10/2011 |
| WO | WO-2012/079000 | | 6/2012 |
| WO | WO-2012/125850 | | 9/2012 |
| WO | WO-2012/141984 | | 10/2012 |
| WO | WO-2012/149364 | | 11/2012 |
| WO | WO-2013/003761 | | 1/2013 |
| WO | WO-2013041029 | A1 | 3/2013 |
| WO | WO-2013/130683 | | 9/2013 |
| WO | WO-2013148049 | A1 | 10/2013 |
| WO | WO-2013149167 | A1 | 10/2013 |
| WO | WO-2013/169338 | | 11/2013 |
| WO | WO-2013/184912 | | 12/2013 |
| WO | WO-2014/089169 | | 6/2014 |
| WO | WO-2014138188 | A1 | 9/2014 |
| WO | WO-2014/198002 | | 12/2014 |
| WO | WO-2014/207063 | | 12/2014 |
| WO | WO-2015/009856 | | 1/2015 |
| WO | WO-2015/107026 | | 7/2015 |
| WO | WO-2015113494 | A1 | 8/2015 |
| WO | WO-2015120363 | A1 | 8/2015 |
| WO | WO-2016/008976 | | 1/2016 |
| WO | WO-2016/011083 | | 1/2016 |
| WO | WO-2016/011264 | | 1/2016 |
| WO | WO-2016/022994 | | 2/2016 |
| WO | WO-2016034678 | A2 | 3/2016 |
| WO | WO-2016/073704 | | 5/2016 |
| WO | WO-2016118577 | A1 | 7/2016 |
| WO | WO-2016/164428 | | 10/2016 |
| WO | WO-2016/168771 | | 10/2016 |
| WO | WO-2016154684 | A1 | 10/2016 |
| WO | WO-2016191643 | A2 | 12/2016 |
| WO | WO-2017/023749 | | 2/2017 |
| WO | WO-2017/029389 | | 2/2017 |
| WO | WO-2017019846 | A1 | 2/2017 |
| WO | WO-2017/048878 | | 3/2017 |
| WO | WO-2017/055547 | | 4/2017 |
| WO | WO-2017106061 | A1 | 6/2017 |
| WO | WO-2017/181148 | | 10/2017 |

(56) References Cited

FOREIGN PATENT DOCUMENTS

| | | | |
|---|---|---|---|
| WO | WO-2017/181152 | | 10/2017 |
| WO | WO-2017/201131 | | 11/2017 |
| WO | WO-2018/022945 | | 2/2018 |
| WO | WO-2018/022946 | | 2/2018 |
| WO | WO-2018/075978 | | 4/2018 |
| WO | WO-2018/170021 | | 9/2018 |
| WO | WO-2018/170026 | | 9/2018 |
| WO | WO-2018170023 | A1 | 9/2018 |
| WO | WO-2019074983 | A1 | 4/2019 |
| WO | WO-2019/136179 | | 7/2019 |
| WO | WO-2020047329 | A1 | 3/2020 |
| WO | WO-2021226553 | A2 | 11/2021 |

OTHER PUBLICATIONS

Burmeister et al., "ICOS controls the pool size of effector-memory and regulatory T cells," The Journal of Immunology, Jan. 2008, 180(2), pp. 774-782.
Canadian Examination Report for Application No. 3053804, dated Dec. 28, 2022, 7 pages.
Chang et al., "The discovery of small molecule carbamates as potent dual alpha(4)beta(1)/alpha(4)beta(7) integrin antagonists," Bioorganic & Medicinal Chemistry Letters, Jan. 2002, 12(2), pp. 159-163.
Chari et al., "Immunoconjugates containing novel maytansinoids: promising anticancer drugs," Cancer Research, Jan. 1992, 52(1), pp. 127-131.
Condomines et al., "Tumor-Targeted Human T Cells Expressing CD28-Based Chimeric Antigen Receptors Circumvent CTLA-4 Inhibition," PLoS One, Jun. 2015, 10(6):e0130518, pp. 1-15.
Corpet, "Multiple sequence alignment with hierarchical clustering," Nucleic Acids Research, Nov. 1988, 16(22), pp. 10881-10890, (URL: multalin.toulouse.inra.fr/multalin/multalin.html.).
David et al., "Protein iodination with solid state lactoperoxidase," Biochemistry, Feb. 1974, 13(5), pp. 1014-1021.
Dull et al., "A Third-Generation Lentivirus Vector with a Conditional Packaging System," Journal of Virology, Nov. 1998, 72(11), pp. 8463-8471.
Duncan et al., "The binding site for C1 q on IgG," Nature. Apr. 21, 1988;332(6166):738-740.
Esensten et al., "CD28 Costimulation: From Mechanism to Therapy," Immunity, 2016, vol. 44(5), pp. 973-988.
European Search Report for Application No. 19704899.4 dated Jan. 11, 2022, 4 pages.
Evans et al., "Generation of Novellmmuno-Oncology Biologics via Directed Evolution of Variant IgSF Domains," Poster Presentation for Immune Checkpoint Inhibitors, Boston, MA (Mar. 14-16, 2017) 1 page.
Evans et al., "Novel immunomodulatory proteins generated via directed evolution of variant IgSF domains," Abstract for AAI Immunology 2017, Washington D.C. (May 12-16, 2017) 1 page Published April A852017.
Evans et al., "Novel immunomodulatory proteins generated via directed evolution of variant IgSF domains," Poster for AAI Immunology 2017, Washington D.C. (May 12-16, 2017) 1 page.
Evans et al., "Therapeutic T Cell Activation Using Engineered Variant IgSF Domains," Poster presented at Society for Immunotherapy of Cancer, National Harbor, MD, (Nov. 9-13, 2016) 1 page.
Ford et al., "Targeting co-stimulatory pathways: transplantation and autoimmunity," Nat Rev Nephrol. (2014) 10(1):14-24.
Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-857.
Garcia-Aragoncillo et al., "Design of virotherapy for effective tumor treatment," Curr Opin Mol Ther. Aug. 2010;12(4):403-411.
Hallden et al., "Oncolytic virotherapy with modified adenoviruses and novel therapeutic targets," Expert Opin Ther Targets. Oct. 2012;16(10):945-958.
Harris et al., "CD80 costimulation is essential for the induction of airway eosinophilia," J Exp Med. Jan. 6, 1997;185(1):177-182.
Hinman L.M., et al., "Preparation and Characterization of Monoclonal Antibody Conjugates of the Calicheamicins: a Novel and Potent Family of Antitumor Antibiotics," Cancer Research, 1993, vol. 53(14), pp. 3336-3342.
Hou et al., "A transendocytosis model of CTLA-4 function predicts its suppressive behavior on regulatory T cells," J Immunol (2015) 94(5):2148-2159.
Hunter et al., "Preparation of iodine-131 labelled human growth hormone of high specific activity," Nature. May 5, 1962; 194:495-496.
International Search Report for Application No. PCT/US2018/022265, mailed Aug. 8, 2018, 9 pages.
Kirn et al., "Targeted and armed oncolytic poxviruses: a novel multi-mechanistic therapeutic class for cancer," Nat Rev Cancer. Jan. 2009;9(1):64-71.
Koenen et al., "A novel bispecific antihuman CD40/CD86 fusion protein with T-cell tolerizing potential," Transplantation (2004) 78(10):1429-1438.
Lazetic et al., "Chimeric co-stimulatory molecules that selectively act through CD28 or CTLA-4 on human T cells," J Biol Chem (2002)11 ;277(41):38660-38668.
Levin et al., "Novel Immunomodulatory Proteins Generated Via Directed Evolution of Variant IgSF Domains," Abstract for Keystone Symposia: Immune Regulation in Autoimmunity and Cancer, Whistler, British page Available to Attendees Feb. 26, 2017 Columbia, Canada (Mar. 26-30, 2017), 1 page.
Levin et al., "Novel Immunomodulatory Proteins Generated Via Directed Evolution of Variant IgSF Domains," Poster presentation for Keystone Symposia: Immune Regulation in Autoimmunity and Cancer, Whistler, British Columbia, Canada (Mar. 26-30, 2017), 1 page.
Lewis et al., "Novel immunomodulatory proteins generated via directed evolution of variant IgSF domains," Abstract for Poster Presentation at the Federation of Clinical Immunology Societies Meeting, Chicago IL 72017(Jun. 14, 2017) 1 page, Published after April.
Lewis et al., "Novel immunomodulatory proteins generated via directed evolution of variant IgSF domains," Poster Presentation at the Federation of Clinical Immunology Societies Meeting, Chicago IL (Jun. 14, 2017), 1 page.
Li et al., "Structure of the human activating natural cytotoxicity receptor NKp30 bound to its tumor cell ligand B7-H6," J Exp Med (2011) 208(4): 703-714.
Lin et al., "Specific and dual antagonists of alpha(4)beta(1) and alpha(4)beta(7) integrins," Bioorg Med Chem Lett. Jan. 21, 2002 ;12(2):133-136.
Lin et al., "The PD-1/PD-L 1 complex resembles the antigen-binding Fv domains of antibodies and T cell receptors," Proc Natl Acad Sci US A. (2008) 105(8):3011-3016.
Lode et al., "Targeted therapy with a novel enediyene antibiotic calicheamicin theta(I)1 effectively suppresses growth and dissemination of liver metastases in a syngeneic model of murine neuroblastoma," Cancer Res. (1998) 58(14):2925-2928.
Lundqvist et al., "31st Annual Meeting and Associated Programs of the Society for Immunotherapy of Cancer (SITC 2016): part one," J Immunother Cancer, (2016) 4(Suppl 1):82, 53 pages.
Lundqvist et al., "31st Annual Meeting and Associated Programs of the Society for Immunotherapy of Cancer (SITC 2016): part two," J Immunother Cancer, (2016) 4(Suppl 1):82, 53 pages.
Mandler et al., "Immunoconjugates of geldanamycin and anti-HER2 monoclonal antibodies: antiproliferative activity on human breast carcinoma cell lines," J Natl Cancer Inst. Oct. 4, 2000;92(19):1573-1581.
Mandler et al., "Modifications in synthesis strategy improve the yield and efficacy of geldanamycin-herceptin immunoconjugates," Bioconjug Chem. Jul.-Aug 2002;13(4):786-791.
Mandler et al., "Synthesis and evaluation of antiproliferative activity of a geldanamycin-Herceptin immunoconjugate," Bioorg Med Chem Lett. May 15, 2000;10(10):1025-1028.
Mauer et al., "ALPN-202, a conditional CD28 costimulator and dual checkpoint inhibitor, utilizes multiple mechanisms to elicit potent

(56) References Cited

OTHER PUBLICATIONS anti-tumor immunity superior to checkpoint blockade alone," Journal for Immunotherapy of Cancer, 7(Suppl 1); p. 793, Abstract SITC 2019, 2 pages.
McLoughlin et al., "TNFerade, an adenovector carrying the transgene for human tumor necrosis factor alpha, for patients with advanced solid tumors: surgical experience and long-term follow-up," Annals of Surgical Oncology, Oct. 12, 2005, 12(10), pp. 825-830.
Mkaddem et al., "Understanding Fc Receptor Involvement in Inflammatory Diseases: From Mechanisms to New Therapeutic Tools," Frontiers in Immunology, 10:811 (Year: 2019), 12 pages.
Narumi et al., "Adenovirus vector-mediated perforin expression driven by a glucocorticoid-inducible promoter inhibits tumor growth in vivo," American Journal of Respiratory Cell and Molecular Biology, Dec. 1998, 19(6), pp. 936-941.
Nygren, "Conjugation of horseradish peroxidase to Fab fragments with different homobifunctional and heterobifunctional cross-linking reagents. A comparative study," The Journal of Histochemistry and Cytochemistry, May 1982, 30(5), pp. 407-412.
Oshima et al., "ASP2408 and ASP2409, novel CTLA4-Ig variants with CD86-selectiveligand binding activity and improved immunosuppressive potency, created by directedevolution," Protein Engineering, Design and Selection (2016) 29(5):159-167.
Pain et al., "Preparation of protein A-peroxidase monoconjugate using a heterobifunctional reagent, and its use in enzyme immunoassays," Journal of Immunological Methods, Jan. 1981, 40(2), pp. 219-230.
Partial European Search Report for Application No. 18793148.0, mailed Mar. 16, 2023, 3 pages.
Peach et al., "Complementarity determining region 1 (CDRI)- and CDR3-analogous regions in CTLA-4 and CD28 determine the binding to B7-1," J Exp Med (1994) 180(6):2049-2058.
Qureshi et al., "Trans-endocytosis of CD80 and CD86: a molecular basis for the cellextrinsic function of CTLA-4," Science (2011) 332(6029):600-603.
Rixon et al., "Novel Immunomodulatory Proteins Generated Via Directed Evolution of Variant IgSF Domains," PEGS: The Essential Protein Engineering Summit, Boston, MA, Apr. 30-May 1, 2018, 1 page. Presentation.
Rixon et al., "Novel Immunomodulatory Proteins Generated Via Directed Evolution of Variant IgSF Domains," PEGS: The Essential Protein Engineering Summit, Boston, MA, Apr. 30-May 1, 2018, 3 pages. Abstract.
Rowland G.F., et al., "Drug Localisation and Growth Inhibition Studies of Vindesine-Monoclonal Anti-CEA Conjugates in a Human Tumour Xenograft," Cancer Immunol Immunotherapy, 1986, vol. 21, No. 3, pp. 183-187.
Sathish et al., "Challenges and approaches for the development of safer immunomodulatory biologics," Nature Reviews Drug Discovery (2013) 12(4):306-324.
Schilderg et al., "Coinhibitory Pathways in the B7-CD28 Ligand-Receptor Family," Immunity. (2016) 44(5): 955-72.
Soskic et al., "Chapter Four—A Transendocytosis Perspective on the CD28/CTLA-4 Pathway," Advance in Immunology (2014) 124:95-136.
Stamper et al., "Crystal structure of the B7-1/CTLA-4 complex that inhibits human immune responses," Nature. (2001) 410(6828):608-611.
Swanson et al., "Therapeutic T Cell Activation Using Engineered Variant IgSF Domains," Abstract for Society for Immunotherapy of Cancer, National Harbor, MD, (Nov. 9-13, 2016), 1 page Published Nov. 8, 2016.
Tareen et al., "Design of a novel integration-deficient lentivector technology that incorporates genetic and posttranslational elements to target human dendritic cells," Mol Ther. (2014) 22(3):575-587.
U.S. Appl. No. 17/923,208, filed Nov. 3, 2022, by Dillon et al.
U.S. Appl. No. 18/161,799, filed Jan. 30, 2023, by Evans et al.
Vitetta et al., "Redesigning Nature's Poisons to Create Anti-Tumor Reagents," Science, Nov. 1987, 238(4830), pp. 1098-1104.
Wekerle et al., "Belatacept: from rational design to clinical application," Transplant International (2012) 25:139-150.
Zhao et al., "A Bispecific Protein Capable of Engaging CTLA-4 and MHCII Protects Non-Obese Diabetic Mice from Autoimmune Diabetes," PLoS One (2013) 8(5):e63530-e63530.
Zhao et al., "TIGIT overexpression diminishes the function of CD4 T cells and ameliorates the severity of rheumatoid arthritis in mouse models," Exp Cell Res. Jan. 1, 2016 ;340(1):132-138.
Zhao et al., "Structural design of engineered costimulation determines tumor rejection kinetics and persistence of CAR T cells," Cancer cell, Oct. 12, 2015; 28(4), pp. 415-428. doi:10.1016/j.ccell.2015.09.004.
Ghiotto, M., et al "PD-L1 and PD-L2 differ in their molecular mechanisms of interaction with PD-1", International Immunology, 2010, vol. 22, No. 8, pp. 651-660.
U.S. Appl. No. 18/355,539, filed Jul. 20, 2023, by Evans et al.
U.S. Appl. No. 16/493,752, filed Sep. 12, 2019, by Swanson et al.
U.S. Appl. No. 17/252,233, filed Dec. 14, 2020, by Swanson et al.
U.S. Appl. No. 17/298,506, filed May 28, 2021, by Swanson et al.
"Database accession No. A0A2K5E9H6," Retrieved from UNIPROT, https://www.uniprot.org/uniprot/A0A2K5E9H6. Retrieved Sep. 13, 2019.
"Database accession No. AER57743 Human B7Rp1 extracellular domain (ECD)" Dated Apr. 19, 2007.
"Database accession No. BDH56778," Retrieved from GENESEQ, Retrieved on Sep. 13, 2019.
"Database accession No. BDV07959," Retrieved from GENESEQ, Retrieved on Sep. 12, 2019.
"Database accession No. A0A2J8M811," Retrieved from UNIPROT, https://www.uniprot.org /uniprot/A0A2J8M811. Retrieved on Mar. 5, 2020.
"Database accession No. A9UFX3," version 38. Retrieved from UNIPROT, http://www.uniprot.org/uniprot/A9UFX3.txt ?. Retrieved on Jan. 18, 2018.
"Database accession No. ADM18706." Retrieved from IBIS, http://ibis/exam/dbfetch.jsp?id=GSP:ADM18706. Retrieved on Oct. 10, 2017.
"Database accession No. ADM18913." Retrieved from IBIS, http://ibis/exam/dbfetch.jsp?id=GSP:ADM18913. Retrieved on Oct. 10, 2017.
"Database accession No. B3TFD9," version 63. Retrieved from UNIPROT, http://www.uniprot.org/uniprot/B3TFD9.txt?version=63. Retrieved on Dec. 10, 2017.
"Database accession No. BCD07227." Retrieved from IBIS, http://ibis/exam/dbfetch.jsp?id=GSP:BCD07227. Retrieved on Oct. 10, 2017.
"Database accession No. BCD07228." Retrieved from IBIS, http://ibis/exam/dbfetch.jsp?id=GSP:BCD07228. Retrieved on Oct. 10, 2017.
"Database accession No. BD020821," Retrieved from GENESEQ, https://www.ebi.ac.uk/ena/data/view/BD020821. Retrieved on May 16, 2018.
"Database accession No. BD020825," Retrieved from GENESEQ, https://www.ebi.ac.uk/ena/data/view/BD020825. Retrieved on May 16, 2018.
"Database accession No. F1PWL4," version 43. Retrieved from UNIPROT, http://www.uniprot.org/uniprot/F1PWL4.txt?version=43. Retrieved on Dec. 10, 2017.
"Database accession No. F7DZ76," version 32. Retrieved from UNIPROT, http://www.uniprot.org/uniprot/F7DZ76. Retrieved on Jun. 6, 2018.
"Database accession No. G1SUI3," version 36. Retrieved from UNIPROT, http://www.uniprot.org/uniprot/G1SUI3.txt. Retrieved on Jun. 6, 2018.
"Database accession No. G3SBS5" Retrieved from UNIPROT, https://www.uniprot.org/uniprot/G3SBS5.txt. Retrieved on Aug. 12, 2021.
"Database accession No. A0A2K5Q1G1" Retrieved from UNIPROT, https://www.uniprot.org/uniprot/A0A2K5Q1G1.txt. Retrieved on Aug. 12, 2021.
"Database accession No. H9Z6Y0," version 15. Retrieved from UNISAVE, http://www.ebi.ac.uk/uniprot/unisave/app/#/content/H9Z6Y0/15. Retrieved on Jun. 20, 2017.

(56) References Cited

OTHER PUBLICATIONS

"Database accession No. L8Y5K4," version 13. Retrieved from UNISAVE, http://www.ebi.ac.uk/uniprot/unisave/app/#/content/L8Y5K4/13. Retrieved on Sep. 28, 2017.
"Database accession No. NP_56074.1," version 1. Retrieved from NCBI, https://www.ncbi.nlm.nih.gov /protein /NP_056074.1, Retrieved on Mar. 3, 2020.
"Database accession No. P32506," version 99. Retrieved from UNIPROT, http://www.uniprot.org/uniprot/P32506.txt ?. Retrieved on Jan. 18, 2018.
Adom et al., "ICOSL+ plasmacytoid dendritic cells as inducer of graft-versus-host disease, responsive to a dual ICOS/CD28 antagonist" Sci Transl Med. (2020) 12(564): eaay4799.
Amatore et al., "Inducible Co-Stimulator (ICOS) as a Potential Therapeutic Target for Anti-Cancer Therapy," Expert Opin Ther Targets. (2018) 22(4): 343-351.
Auffermann-Gretzinger et al., "Rapid establishment of dendritic cell chimerism in allogeneic hematopoietic cell transplant recipients," Blood. (2002)99(4): 1442-1448.
Baban et al., "Bacteria as vectors for gene therapy of cancer," Bioeng Bugs. (2010) 1(6):385-394.
Bachmann et al., "The EVH2 Domain of the Vasodilator-stimulated Phosphoprotein Mediates Tetramerization, F-actin Binding, and Actin Bundle Formation," J Biol Chem. (1999) 274(33):23549-23557.
Banovic et al., "Graft-versus-host disease prevents the maturation of plasmacytoid dendritic cells," J Immunol. (2009) 182(2): 912-920.
Behr et al., "Trastuzumab and breast cancer," N Engl J Med.(2001) 345:995-996.
Boder et al.. "Optimal screening of surface-displayed polypeptide libraries," Biotechnol Prog. (1998) 14:55-62.
Brown et al., "Structure-based mutagenesis of the human immunodeficiency virus type 1 DNA attachment site: effects on integration and cDNA synthesis," J Virol. (1999) 73(11):9011-9020.
Bruggemann et al., "Comparison of the effector functions of human immunoglobulins using a matched set of chimeric antibodies," J Exp Med. (1987) 166(5):1351-1361.
Buchschacher et al., "Human immunodeficiency virus vectors for inducible expression of foreign genes," J Virol. (1992) 66(5):2731-2739.
Busch et al., "Dimers, leucine zippers and DNA-binding domains," Trends Genet. (1990)6(2): 36-40.
Carter et al., "Cytotoxic T-lymphocyte antigen-4 and programmed death-1 function as negative regulators of lymphocyte activation," Immunol Res (2003) 28:49-59.
Carter et al., "Humanization of an anti-p185HER2 antibody for human cancer therapy," Proc Natl Acad Sci USA (1992) 89:4285-4289.
Chakrabarti et al., "A mutant B7-1/Ig fusion protein that selectively binds to CTLA-4 ameliorates anti-tumor DNA vaccination and counters regulatory T cell activity", Vaccine, Elsevier, Amsterdam, NL, vol. 23, No. 37, Aug. 31, 2005 pp. 4553-4564.
Chao et al., "Isolating and engineering human antibodies using yeast surface display," Nat Protoc. (2006) 1:755-768.
Chattopadhyay et al., "Structural basis of inducible costimulator ligand costimulatory function: determination of the cell surface oligomeric state and functional mapping of the receptor binding site of the protein," J Immunol. Sep. 15, 2006;177(6):3920-9.
Clynes et al., "Fc receptors are required in passive and active immunity to melanoma," Proc Natl Acad Sci U S A. (1998) 95(2):652-656.
Colby et al., "Engineering antibody affinity by yeast surface display," Methods Enzymol. 2004;388:348-58.
Colcher et al., "Use of monoclonal antibodies as radiopharmaceuticals for the localization of human carcinoma xenografts in athymic mice," Methods Enzymol. (1986); 121: 802-16.
Cornetta et al., "No retroviremia or pathology in long-term follow-up of monkeys exposed to a murine amphotropic retrovirus," Hum Gene Ther. (1991) Fall;2(3):215-9.
Covassin et al., "Human peripheral blood CD4 T cell-engrafted non-obese diabetic-scid IL2ry(null) H2-Ab1 (tm1Gru) Tg (human leucocyte antigen D-related 4) mice: a mouse model of human allogeneic graft-versus-host disease," Clin Exp Immunol. 2011 166(2): 269-280.
Cragg et al., "Antibody specificity controls in vivo effector mechanisms of anti-CD20 reagents," Blood. (2004) 103(7):2738-2743.
Cragg et al., "Complement-mediated lysis by anti-CD20 mAb correlates with segregation into lipid rafts," Blood. (2003) 101(3):1045-1052.
Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.
Derer et al., Complement in antibody-based tumor therapy. Crit Rev Immunol. (2014) 34:199-214.
Despoix et al., "Mouse CD146/MCAM is a marker of natural killer cell maturation", Eur J Immunol. (2008) 38(10): 2855-2864.
Ehx et al., "Xenogeneic Graft-Versus-Host Disease in Humanized NSG and NSG-HLA-A2/HHD Mice", Front Immunol. (2018) 9:1943.
Ellis et al., "Interactions of CD80 and CD86 with CD28 and CTLA4,"J Immunol (1996) 156:2700-2709.
Engelman et al., "Multiple effects of mutations in human immunodeficiency virus type 1 integrase on viral replication," J Virol. 1995 69(5):2729-2736.
Fargeas et al., "Identification of residues in the V domain of CD80 (B7-1) implicated in functional interaction with CD28 and CTLA4", Journal of Experimental Medicine, vol. 182, No. 3. Sep. 1, 1995 pp. 667-675.
Ferrara et al., "Regenerating islet-derived 3-alpha is a biomarker of gastrointestinal graft-versus-host disease," Blood. (2011) 118(25): 6702-6708.
Forcade et al., "An activated Th17-prone T cell subset involved in chronic graft-versus-host disease sensitive to pharmacological inhibition," JCI Insight. (2017) 2(12): e92111.
Fowler et al., "R707, a fully human antibody directed against CC-chemokine receptor 7, attenuates xenogeneic acute graft-versus-host disease", Am J Transplant. (2019) 19(7): 1941-1954.
Freeman et al., "Engagement of the PD-1 immunoinhibitory receptor by a novel B7 family member leads to negative regulation of lymphocyte activation," J Exp Med (2000) 192(7):1027-1034.
Gazzano-Santoro et al., "A non-radioactive complement-dependent cytotoxicity assay for anti-CD20 monoclonal antibody," J Immunol Methods. Mar. 28, 1997;202(2):163-71.
Gentz et al., "Parallel association of Fos and Jun leucine zippers juxtaposes DNA binding domains," Science. (1989) 243(4899): 1695-1699.
Gherardi et al., "Recombinant poxviruses as mucosal vaccine vectors," J Gen Virol. (2005) 86(Pt 11):2925-2936.
Gregoire-Gauthier et al., "Use of immunoglobulins in the prevention of GvHD in a xenogeneic NOD/SCID/gammac-mouse model," Bone Marrow Transplant (2012) 47:439-450.
Guerra et al., "Host response to the attenuated poxvirus vector NYVAC: upregulation of apoptotic genes and NF-kappaB-responsive genes in infected Hela cells," J Virol. (2006) 80(2): 985-98.
Gunasekaran et al., "Enhancing antibody Fc heterodimer formation through electrostatic steering effects: applications to bispecific molecules and monovalent IgG," J Biol Chem (2010) 285(25):19637-19646.
Halaby et al., "The immunoglobulin superfamily: an insight on its tissular, species, and functional diversity," J Mol Evol (1998) 46:89-400.
Hartwell et al., "An early-biomarker algorithm predicts lethal graft-versus-host disease and survival," JCI Insight. (2017) 2(3): e89798.
Hellstrom et al., "Antitumor effects of L6, an IgG2a antibody that reacts with most human carcinomas," Proc Natl Acad Sci U S A. (1986) 83(18):7059-7063.
Hellstrom et al., "Strong antitumor activities of IgG3 antibodies to a human melanoma-associated ganglioside," Proc Natl Acad Sci U S A. (1985) 82(5):1499-1502.

(56) References Cited

OTHER PUBLICATIONS

Hoseini et al., "A potent tetravalent T-cell-engaging bispecific antibody against CD33 in acute myeloid leukemia", Blood Adv. Jun. 12, 2018;2(11):1250-1258.
Hu et al., "Yaba-like disease virus: an alternative replicating poxvirus vector for cancer gene therapy," J Virol. (2001) 75(21):10300-10308.
Huston et al., "Protein engineering of antibody binding sites: recovery of specific activity in an anti-digoxin single-chain Fv analogue produced in *Escherichia coli*," PNAS (1988) 85(16):5879-5883.
Idusogie et al., "Mapping of the C1q binding site on rituxan, a chimeric antibody with a human IgG1 Fc," J Immunol. (2000) 164(8):4178-4184.
Infante et al., "Overview Clinical and Pharmacodynamic (PD) Results of a Phase 1 Trial with AMP-224 (B7-DC Fc) that Binds to the PD-1 Receptor," Journal of Clinical Oncology (2013) 31(15_ suppl):3044-3044.
Jenkins et al., "CD28 delivers a costimulatory signal involved in antigen-specific IL-2 production by human T cells," J Immunol. (1991) 147:2461-6.
Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.
Jones et al., "Peripherally Induced Regulatory T Cells: Recruited Protectors of the Central Nervous System against Autoimmune Neuroinflammation," Front Immunol (2017) 8:532.
Kabat et al., "Sequences of Proteins of Immunological Interest," Fifth Edition, U.S. Department of Health and Human Services, NIH Publication No. 91-3242 (1991), 83 pages.
Kamphorst et al., "Rescue of exhausted CD8 T cells by PD-1-targeted therapies is CD28-dependent," Science (2017) 355(6332):1423-1427.
Ke et al., "Rapid and efficient site-directed mutagenesis by single-tube 'megaprimer' PCR method," Nucleic Acids Research (1997) 25(16):3371-3372.
Khalil et al., "The future of cancer treatment: immunomodulation, CARs and combination immunotherapy," Nat Rev Clin Oncol. (2016) 13(5):273-90.
Khan et al., "Characterization of the New World monkey homologues of human poliovirus receptor CD155," J Virol. Jul. 2008;82(14):7167-79.
Kim et al., "Programmed cell death ligand 1 alleviates psoriatic inflammation by suppressing IL-17A production from programmed cell death 1-high T cells," J Allergy Clin Immunol (2016) 137(5):1466-1476.
Koike et al., "A second gene for the African green monkey poliovirus receptor that has no putative N-glycosylation site in the functional N-terminal immunoglobulin-like domain," J Virol. Dec. 1992;66(12):7059-66.
Kojima et al., "Fusion Protein of Mutant B7-DC and Fc Enhances the Antitumor Immune Effect of GM-CSF-secreting Whole-cell Vaccine," J Immunother. (2014) 37(3):147-54.
Kolberg, "Gene-transfer virus contaminant linked to monkey's cancer," J Nih Res. (1992) 4:43-44.
Koura et al., "In vivo T cell costimulation blockade with abatacept for acute graft-versus-host disease prevention: a first-in-disease trial", Biol Blood Marrow Transplant. (2013) 19(11): 1638-1649.
Koyama et al., "Plasmacytoid dendritic cells prime alloreactive T cells to mediate graft-versus-host disease as antigen-presenting cells," Blood. (2009) 113(9): 2088-2095.
Kremer et al., "Treatment of rheumatoid arthritis by selective inhibition of T-cell activation with fusion protein CTLA4Ig," N Engl J Med (2003) 349(20):1907-1915.
Labrijn et al., "Therapeutic IgG4 antibodies engage in Fab-arm exchange with endogenous human IgG4 in vivo," Nat Biotechnol. Aug. 2009;27(8):767-71.
Laouar et al., "STAT3 is required for Flt3L-dependent dendritic cell differentiation," Immunity. (2003) 19(6): 903-912.
Larsen et al., "Rational development of LEA29Y (belatacept), a high-affinity variant of CTLA4-Ig with potent immunosuppressive properties," Am J Transplant. Mar. 2005;5(3):443-53.
Leabman et al., "Effects of altered FcγR binding on antibody pharmacokinetics in cynomolgus monkeys," MAbs. (2013) 5(6):896-903.
Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.
Li et al., "Proteomics analysis reveals a Th17-prone cell population in presymptomatic graft-versus-host disease," JCI Insight. (2016) 1(6): e86660.
Lindblad-Toh et al., "A high-resolution map of human evolutionary constraint using 29 mammals," Nature (2011) 478(7370):476-482.
Lindblad-Toh et al., "Genome sequence, comparative analysis and haplotype structure of the domestic dog," Nature. Dec. 8, 2005;438(7069):803-19.
Linderholm et al (Bio Process International, 2014, 12(10): 20-27.
Linsley et al., "Human B7-1 (CD80) and B7-2 (CD86) bind with similar avidities but distinct kinetics to CD28 and CTLA-4 receptors," Immunity. (1994) 1(9): 793-801.
Liu et al., "Crystal structure of cell adhesion molecule nectin-2/CD112 and its binding to immune receptor DNAM-1/CD226," J Immunol. Jun. 1, 2012;188(11):5511-20.
Markey et al., "Conventional dendritic cells are the critical donor APC presenting alloantigen after experimental bone marrow transplantation", Blood. 2009 113(22): 5644-5649.
Markey et al., "Recipient plasmacytoid DCs are not required to prime allogeneic T-cell responses after BMT," Blood. (2009) 113(23): 6038-6039.
Markey et al., "Flt-3L Expansion of Recipient CD8α + Dendritic Cells Deletes Alloreactive Donor T Cells and Represents an Alternative to Posttransplant Cyclophosphamide for the Prevention of GVHD", Clin Cancer Res. (2018) 24(7): 1604-1616.
Martin et al., "Increasingly frequent diagnosis of acute gastrointestinal graft-versus-host disease after allogeneic hematopoietic cell transplantation," Biol Blood Marrow Transplant. (2004) 10(5): 320-327.
Mataki et al., "Expression of PD-1, PD-L1, and PD-L2 in the Liver in Autoimmune Liver Diseases," Am J Gastroenterol (2007) 102:302-312.
Maurer et al., "ALPN-202 combines checkpoint inhibition with conditional T cell costimulation to overcome T cell suppression by M2c macrophages and improve the durability of engineered T cell anti-tumor responses," AACR Annual Meeting 2020 ;Cancer Res (2020) 80(16suppl):Abstract nr LB-085.
Maute et al., "Engineering high-affinity PD-1 variants for optimized immunotherapy and immuno-PET imaging," Proc Natl Acad Sci U S A. (2015) 112(47): E6506-14.
Mayr et al., "Passage history, properties, and applicability of the attenuated vaccinia virus strain MVA," Infection. (1975);3:6-14. (English translation of abstract provided).
McDonald et al., "Plasma biomarkers of acute GVHD and nonrelapse mortality: predictive value of measurements before GVHD onset and treatment," Blood. (2015) 126(1): 113-120.
McWilliams et al., "Mutations in the 5' end of the human immunodeficiency virus type 1 polypurine tract affect RNase H cleavage specificity and virus titer," J Virol. (2003) 77(20):11150-11157.
Mease et al., "Efficacy and safety of abatacept, a T-cell modulator, in a randomised, double-blind, placebo-controlled, phase III study in psoriatic arthritis," Ann Rheum Dis. (2017) 76:1550-8.
Merchant et al., "An efficient route to human bispecific IgG," Nat Biotechnol. (1998) 16(7): 677-681.
Mercier et al., "A chimeric adenovirus vector encoding reovirus attachment protein sigma1 targets cells expressing junctional adhesion molecule 1," Proc Natl Acad Sci U S A. (2004) 101(16): 6188-6193.
Mezzadra et al., "Identification of CMTM6 and CMTM4 as PD-L1 protein regulators," Nature (2017) 549(7670):106-110.
Miller et al., "Construction and properties of retrovirus packaging cells based on gibbon ape leukemia virus," J Virol. (1991) 65(5):2220-2224.

(56) References Cited

OTHER PUBLICATIONS

Miller et al., "Construction and screening of antigen targeted immune yeast surface display antibody libraries," Curr Protoc Cytom. Jul. 2008;Chapter 4:Unit4.7.
Miller et al., "Gene transfer by retrovirus vectors occurs only in cells that are actively replicating at the time of infection," Mol Cell Biol. (1990) 10(8):4239-4242.
Miller, "Protein-protein recognition and the association of immunoglobulin constant domains," J Mol Biol. Dec. 20, 1990;216(4):965-73.
Milone et al., "Chimeric receptors containing CD137 signal transduction domains mediate enhanced survival of T cells and increased antileukemic efficacy in vivo," Mol Ther. (2009) 17(8):1453-64.
Miyoshi et al. "Development of a self-inactivating lentivirus vector," J Virol. (1998) 72(10):8150-8157.
Mizuhara et al., "T cell activation-associated hepatic injury: mediation by tumor necrosis factors and protection by interleukin 6," J Exp Med. 1994 179(5): 1529-1537.
Mochizuki et al., "Delta-like ligand 4 identifies a previously uncharacterized population of inflammatory dendritic cells that plays important roles in eliciting allogeneic T cell responses in mice," J Immunol. (2013) 190(7): 3772-82.
Molin et al., "Two novel adenovirus vector systems permitting regulated protein expression in gene transfer experiments," J Virol. (1998) 72(10):8358-8361.
Morton et al., "Differential effects of CTLA-4 substitutions on the binding of human CD80 (B7-1) and CD86 (B7-2)," J Immunol. (1996) 156(3):1047-1054.
Newton et al., "Angiogenin Single-Chain Immunofusions: Influence of Peptide Linkers and Spacers between Fusion Protein Domains," Biochemistry (1996) 35(2):545-553.
Nightingale et al., "Transient gene expression by nonintegrating lentiviral vectors," Mol Ther. (2006) 13(6):1121-1132.
Nishimori et al., "Identification and characterization of bovine programmed death-ligand 2," Microbiol Immunol. (2014) 58(7):388-97.
Ochoa et al., "Antibody-dependent cell cytotoxicity: immunotherapy strategies enhancing effector NK cells," Immunol Cell Biol. (2017) 95:347-55.
Paczesny, "Biomarkers for posttransplantation outcomes," Blood. (2018) 131(20): 2193-2204.
Paczesny et al., "A biomarker panel for acute graft-versus-host disease," Blood. (2009) 113(2): 273-278.
Paczesny et al., "Elafin is a biomarker of graft-versus-host disease of the skin," Sci Transl Med. (2010) 2(13): 13ra2.
Parslow et al., "Antibody-drug conjugates for cancer therapy," Biomedicines. (2016) 4:E32.
Patton et al., "Evaluation of the efficiency of human immune system reconstitution in NSG mice and NSG mice containing a human HLA.A2 transgene using hematopoietic stem cells purified from different sources", J Immunol Methods. (2015) 422: 13-21.
Patyar et al., "Bacteria in cancer therapy: a novel experimental strategy," J Biomed Sci. (2010) 17(1):21.
Paulos et al., "The inducible costimulator (ICOS) is critical for the development of human T(H)17 cells", Sci Transl Med. (2010) 2(55): 55ra78.
Peach et al., "Both extracellular immunoglobin-like domains of CD80 contain residues critical for binding T cell surface receptors CTLA-4 and CD28," J Biol Chem. (1995) 270(36):21181-7.
Penix et al., "Two essential regulatory elements in the human interferon gamma promoter confer activation specific expression in T cells," J Exp Med. (1993) 178(5):1483-1496.
Peper et al., "An impedance-based cytotoxicity assay for real-time and label-free assessment of T-cell-mediated killing of adherent cells," J Immunol Methods. Mar. 2014;405:192-8.
Pérez De La Lastra et al., "Epitope mapping of 10 monoclonal antibodies against the pig analogue of human membrane cofactor protein (MCP)," Immunology. (1999) 96(4):663-70.
Petkova et al., "Enhanced half-life of genetically engineered human IgG1 antibodies in a humanized FcRn mouse model: potential application in humorally mediated autoimmune disease," Int Immunol. (2006) 18(12):1759-1769.
Pfeifer et al., "Gene therapy: promises and problems," Annu Rev Genomics Hum Genet. (2001);2:177-211.
Philpott et al., "Use of nonintegrating lentiviral vectors for gene therapy," Hum Gene Ther. (2007) 18(6): 483-9.
Powell et al., "Sequence and structural determinants required for priming of plus-strand DNA synthesis by the human immunodeficiency virus type 1 polypurine tract," J Virol. (1996) 70(8):5288-5296.
Ramadan et al., "From proteomics to discovery of first-in-class ST2 inhibitors active in vivo," JCI Insight. (2018) 3(14): e99208.
Ravetch et al., "Fc receptors," Annu Rev Immunol. (1991) 9:457-492.
Reizis et al., "Plasmacytoid Dendritic Cells: Development, Regulation, and Function," Immunity. (2019) 50(1): 37-50.
Ren et al., "The search for drug-targetable diagnostic, prognostic and predictive biomarkers in chronic graft-versus-host disease," Expert Rev Clin Immunol. (2018) 14(5): 389-404.
Rennert et al., "The IgV domain of human B7-2 (CD86) is sufficient to co-stimulate T lymphocytes and induce cytokine secretion," International Immunology (1997) 9(6):805-813.
Rentero et al., "Screening of Large Molecule Diversities by Phage Display," Chimia (Aarau) (2011) 65(11): 843-845.
Reynoso et al., "Intestinal Tolerance Is Converted to Autoimmune Enteritis upon PD-1 Ligand Blockade," J Immunol (2009) 182(4):2102-2112.
Ridgway et al., "'Knobs-into-holes' engineering of antibody CH3 domains for heavy chain heterodimerization," Protein Eng. Jul. 1996;9(7):617-21.
Ramos et al., "FMS-related tyrosine kinase 3 ligand (Flt3L)/CD135 axis in rheumatoid arthritis", Arthritis Res Ther. (2013) 15(6):R209.
Rosenberg et al., "Use of tumor-infiltrating lymphocytes and interleukin-2 in the immunotherapy of patients with metastatic melanoma. A preliminary report," N Engl J Med. (1988) 319(25):1676-1680.
Rozali et al., "Programmed death ligand 2 in cancer-induced immune suppression," Clin Dev Immunol (2012) 2012:656340.
Ruperto et al., Abatacept in children with juvenile idiopathic arthritis: a randomised, double-blind, placebo-controlled withdrawal trial. Lancet. (2008) 372:383-391.
Sadelain, M. et al., "The basic principles of chimeric antigen receptor design." Cancer Discov., Apr. 2013, vol. 3, No. 4, pp. 388-398.
Sarmay et al (Mol Immunol, 1992, 29(5): Abstract).
Scatchard et al., "The attractions of proteins for small molecules and ions," Ann. N.Y. Acad. Sci. (1949) 51:660.
Scholten et al., "Promiscuous behavior of HPV16E6 specific T cell receptor beta chains hampers functional expression in TCR transgenic T cells, which can be restored in part by genetic modification," Cell Oncol. (2010) 32:43-56.
Seow et al., "Biological gene delivery vehicles: beyond viral vectors," Mol Ther. (2009) 17(5):767-777.
Shenoi et al., "Comparison of biomarkers for systemic juvenile idiopathic arthritis," Pediatric Research (2015) 78(5):554-559.
Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem. (2001) 276(9):6591-6604.
Sim et al., "Altered expression of costimulatory molecules in Behçet's disease according to clinical activity," Br J Dermatol (2011) 164(6):1285-1291.
Sommerfelt et al., "Receptor interference groups of 20 retroviruses plating on human cells," Virology. (1990) 176(1): 58-69.
Song et al., "Protective effects of Fc-fused PD-L1 on two different animal models of colitis," Gut (2015) 64:260-271.
Srinivasan et al., "Immunomodulatory peptides from IgSF proteins: a review," Curr Protein Pept Sci. (2005) 6(2):185-96.
Srivastava et al., "Engineering CAR-T cells: Design Concepts," Trends in Immunology (2015) 36(8):494-502.

(56) References Cited

OTHER PUBLICATIONS

Strohl, "Optimization of Fc-mediated effector functions of monoclonal antibodies," Curr Opin Biotechnol. Dec. 2009;20(6):685-91.
Sturmhoefel et al., "Potent Activity of Soluble B7-IgG Fusion Proteins in Therapy of Established Tumors and as Vaccine Adjuvant," Cancer Res. (1999) 59(19): 4964-4972.
Swanson et al., "CD80 vIgD-Fc proteins combine checkpoint antagonism and costimulatory signaling for elicit potent anti-tumor immunity in vitro and in vivo" American Association for Cancer Research (AACR). Chicago, IL, Apr. 14-18, 2018, Abstract 4550, 1 page, published Jul. 2018.
Tangney et al., "The use of Listeria monocytogenes as a DNA delivery vector for cancer gene therapy," Bioeng Bugs. (2010) 1(4):284-287.
Tartaglia et al., "Highly attenuated poxvirus vectors," AIDS Res Hum Retroviruses. (1992) 8(8):1445-1447.
Taylor et al., "Targeting of inducible costimulator (ICOS) expressed on alloreactive T cells down-regulates graft-versus-host disease (GVHD) and facilitates engraftment of allogeneic bone marrow (BM)", Blood. (2005) 105(8): 3372-3380.
Terawaki et al., "Specific and high-affinity binding of tetramerized PD-L1 extracellular domain to PD-1-expressing cells: possible application to enhance T cell function," Int Immunol (2007) 19(7):881-890.
Teshima et al., "Response: Recipient plasmacytoid dendritic cells and graft-versus-host disease", Blood. (2009) 114(6): 1280.
Thompson et al., "cis-acting sequences required for inducible interleukin-2 enhancer function bind a novel Ets-related protein, Elf-1," Mol Cell Biol. (1992) 12(3):1043-1053.
Tiegs et al., "A T cell-dependent experimental liver injury in mice inducible by concanavalin A." J Clin Invest. (1992) 90(1): 196-203.
Todd et al., "Transcription of the interleukin 4 gene is regulated by multiple promoter elements," J Exp Med. (1993) 177(6):1663-1674.
Topalian et al., "Safety, activity, and immune correlates of anti-PD-1 antibody in cancer," N engl J Med (2012) 366:2443-2454.
Toyabe et al., "Requirement of IL-4 and liver NK1+ T cells for concanavalin A-induced hepatic injury in mice," J Immunol (1997) 159:1537-1542.
Uniprot H9Z6YO Icos ligand Retrieved from https://www.uniprot.org/uniprot/H9Z6Y0. Retrieve on Jul. 10, 2020.
Uniprot L8Y5K4 Icos Ligand Retrieved from https://www.uniprot.org/uniprot/L8Y5K4. Retrieved on Jul. 10, 2020.
Uzzaman et al., "Classification of hypersensitivity reactions," Allergy Asthma Proc. (2012) 33: S96 -S99.
Vafa et al., "An engineered Fc variant of an IgG eliminates all immune effector functions via structural perturbations," Methods. (2014) 65(1):114-26.
Van Der Lugt et al., "ST2 as a marker for risk of therapy-resistant graft-versus-host disease and death," N Engl J Med. (2013) 369(6): 529-539.
Van Der Merwe et al.. "CD80 (B7-1) binds both CD28 and CTLA-4 with a low affinity and very fast kinetics," J exp Med (1997) 185:393-403.
Van Pijkeren et al., "A novel Listeria monocytogenes-based DNA delivery system for cancer gene therapy," Hum Gene Ther. Apr. 2010;21(4):405-16.
Vincenti et al., "Costimulation blockade with belatacept in renal transplantation," N Engl J Med. (2005) 353:770-81.
Voulgaraki et al., "Multivalent recombinant proteins for probing functions of leucocyte surface proteins such as the CD200 receptor," Immunology. (2005) 115(3): 337-346.
Wade et al., "Genome sequence, comparative analysis, and population genetics of the domestic horse," Science. Nov. 6, 2009;326(5954):865-867.
Wang et al., "In vitro characterization of the anti-PD-1 antibody nivolumab, BMS-936558, and in vivo toxicology in non-human primates," Cancer Immunol Res. (2014) 2(9):846-856.
Wang et al., "Molecular cloning, characterization and three-dimensional modeling of porcine nectin-2/CD112," Vet Immunol Immunopathol. 2009 132(2-4):257-63.
Wang et al., "Molecular modeling and functional mapping of B7-H1 and B7-DC uncouple costimulatory function from PD-1 interaction," J Exp Med. 2003 197(9):1083-91.
Watkins et al., "CD28 blockade controls T cell activation to prevent graft-versus-host disease in primates", J Clin Invest. (2018) 128(9): 3991-4007.
Weber et al., "ICOS maintains the T follicular helper cell phenotype by down-regulating Kruppel-like factor 2," J Exp Med. (2015) 212:217-33.
Wei et al., "Strength of PD-1 signaling differentially affects T-cell effector functions," PNAS (2013) 110(27):E2480-E2489.
Wikenheiser et al., "ICOS Co-Stimulation: Friend or Foe?," Front Immunol (2016) (7):304, 16 pgs.
Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.
Wilson et al., Analyzing biomolecular interactions, Science. (2002) 295(5562): 2103-2105.
Whitlow et al., "An improved linker for single-chain Fv with reduced aggregation and enhanced proteolytic stability," Protein Eng (1993) 6(8):989-995.
Wolchok et al.,Development of ipilimumab: a novel immunotherapeutic approach for the treatment of advanced melanoma. Ann N Y Acad Sci. (2013) 1291:1-13.
Wolff et al., "Monoclonal Antibody Homodimers: Enhanced Antitumor Activity in Nude Mice," Cancer Res. (1993) 53(11): 2560-2565.
Wu et al., "CTLA-4-B7 Interaction Is Sufficient to Costimulate T Cell Clonal Expansion," J. Exp. Med. (1997) 185(7):1327-1335.
Wu et al., "IL-24 modulates IFN-gamma expression in patients with tuberculosis," Immunol Lett. (2008) 117(1):57-62.
Xu et al., "Affinity and cross-reactivity engineering of CTLA4-lg to modulate T cell costimulation," J Immunol (2012) 189(9):4470-4477.
Yao et al., "B7-h2 is a costimulatory ligand for CD28 in human," Immunity. (2011) 34(5):729-40.
Yokosuka et al., "Programmed cell death 1 forms negative costimulatory microclusters that directly inhibit T cell receptor signaling by recruiting phosphatase SHP2," J Exp Med (2012) 209(6):1201-1217.
Yoshinaga et al., cell co-stimulation through B7RP-1 and ICOS. Nature. (1999) 402:827-832.
Yu et al., "The role of B7-CD28 co-stimulation in tumor rejection," Int Imm (1998) 10(6):791-797.
Zamani et al., "PD-1/PD-L and autoimmunity: A growing relationship," Cell Immunol (2016) 310:27-41.
Zapata et al., "Engineering linear F(ab')2 fragments for efficient production in *Escherichia coli* and enhanced antiproliferative activity," Protein Eng. (1995) 8(10): 1057-62.
Zeiser et al., "Acute Graft-versus-Host Disease—Biologic Process, Prevention, and Therapy", N Engl J Med. Nov. 30, 2017;377(22):2167-2179.
Zhang et al., "Immunoinhibitory checkpoint deficiency in medium and large vessel vasculitis," PNAS (2017) 114(6):E970-E979.
Zhang et al., "An NKp30-Based Chimeric Anitgen Receptor Promotes T Cell Effector Functions and Antitumor Efficacy In Vivo," J Immunol (2012) 189:2290-2299.
Zhang et al., "Crystal structure of the receptor-binding domain of human B7-2: insights into organization and signaling," Proc Natl Acad Sci U S A. (2003) 100(5):2586-91.
Zhang et al., "Preterminal host dendritic cells in irradiated mice prime CD8+ T cell-mediated acute graft-versus-host disease," J Clin Invest. (2002) 109(10): 1335-1344.
Zhang et al., "ST2 blockade reduces sST2-producing T cells while maintaining protective mST2-expressing T cells during graft-versus-host disease", Sci Transl Med. (2015) 7(308): 308ra160.
Zhong et al., "Lower expression of PD-1 and PD-L1 in peripheral blood from patients with chronic ITP," Hematology (2016) 21(9):552-557.
Zhou et al., "Endogenous programmed death ligand-1 restrains the development and onset of Sjögren's syndrome in non-obese diabetic mice," Scientific Reports. (2016) vol. 6; Article No. 39105.

(56) References Cited

OTHER PUBLICATIONS

Zimin et al., "A new rhesus macaque assembly and annotation for next-generation sequencing analyses," Biol Direct. Oct. 14, 2014;9(1):20.
Zufferey et al., "Self-inactivating lentivirus vector for safe and efficient in vivo gene delivery," J Virol. (1998) 72(12):9873-9880.
Buchbinder et al., "CTLA-4 and PD-1 Pathways Similarities, Differences, and Implications of Their Inhibition," American Journal of Clinical Oncology, vol. 39, No. 1, Feb. 2016, pp. 98-106, https://pubmed.ncbi.nlm.nih.gov/26558876/.
Lobner E, et al., "Engineered IgG1-Fc-one fragment to bind them all", Immunological Reviews, Mar. 2016, vol. 270(1), pp. 113-131.
Metzler, W. et al., "Solution structure of human CTLA-4 and delineation of a CD80/CD86 binding site conserved in CD28," Nature Structural Biology, Jul. 1, 1997, vol. 4(7), pp. 527-531.
Moreland, L., et al., "Abatacept", Nature Reviews Drug Discovery, vol. 5, No. 3, Mar. 1, 2006, pp. 185-186.
Partial European Search Report for European Application No. 23153416.5 dated Aug. 4, 2023, 15 pages.
Maurer et al., ALPN-202, combines checkpoint inhibition with conditional T cell costimulation to overcome T cell suppression by M2c macrophages and improve the durability of engineered T cell anti-tumor responses, AACR Annual Meeting 2020, Abstract, 1-4 (2020).

* cited by examiner

| | PD-L1 303 – ICOSL 2264 | PD-L2 1417 – ICOSL 2264 | PD-L2 1417 |
|---|---|---|---|
| Hill Slope | 1.201 | 1.036 | |
| EC50 | 2.662e-011 | 2.622e-010 | |
| S:B | 2.4 | 2.6 | - |

| | PD-L1 303 – ICOSL 2264 | PD-L2 1417 – ICOSL 2264 | PD-L2 1417 |
|---|---|---|---|
| Hill Slope | 1.32 | 1.029 | |
| EC50 | 3.02e-011 | 4.088e-010 | |
| S:B | 4.1 | 3.7 | - |

| | PD-L1 303 – ICOSL 2264 | PD-L2 1417 – ICOSL 2264 | PD-L2 1417 |
|---|---|---|---|
| Hill Slope | 1.4 | 1.361 | ~191.9 |
| EC50 | 1.104e-010 | 5.323e-010 | ~4.207e-010 |
| S:B | 5.1 | 2.6 | 1.1 |

| | PD-L1 303 – ICOSL 2264 | PD-L1 – Fc |
|---|---|---|
| Hill Slope | 1.009 | 0.752 |
| EC50 | 1.147e-009 | ~2.852e-005 |
| S:B | 3.7 | 5.0 |

| | PD-L2 1417 | PD-L1 – Fc |
|---|---|---|
| Hill Slope | | 1.164 |
| EC50 | | 7.05e-007 |
| S:B | - | 4.8 |

- PD-L1 303 – CTLA-4 3495 – Fc
- PD-L2 1417 – CTLA-4 3495 – Fc
- PD-L1 303 – CTLA-4 2655 – Fc
- CTLA-4 3037 – PD-L1 303 – Fc
- PD-L1 303 – CTLA-4 3037 – Fc
- Anti-PD-1 monoclonal antibody (nivolumab)
- PD-L1 303 - Fc
- PD-L2 1417 - Fc
- Fc control

- PD-L1 303 – PD-L1 303 – ICOSL 2264 – ICOSL 2264
- PD-L1 303 – ICOSL 2264 – PD-L1 303
- PD-L1 303 – ICOSL 2264 – ICOSL 2264 – PD-L1 303
- PD-L1 303 – ICOSL 2264 – COMP
- PD-L1 303 – ICOSL 2264
- PD-L1 303 – COMP
- ICOSL 2264
- PD-L1 303

- PD-L1 303 – ICOSL 2266 – Fc
- PD-L1 303 – ICOSL 2264 – Fc
- Variant CTLA-4-Ig (belatacept)
- CTLA-4-Ig (abatacept)
- ICOSL 2266 - Fc (SEFL SEQ ID NO:1157)
- ICOSL 2264 – Fc
- PD-L1 303 – Fc
- Fc control CD58 3650 – PD-L1 303 – Fc (SEQ ID NO: 3680)
PD-L1 303 – CD58 3650 – Fc (SEQ ID NO: 3682)
CD58 3650 – CD58 3650 – ICOSL 2264 – ICOSL 2264
PD-L1 303 – PD-L1 303 – CD58 3650 – CD58 3650 (SEQ ID NO: 3684)
CD58 3650 – CD58 3650 – PD-L1 303 – PD-L1 303 (SEQ ID NO: 3686)
CD58 3650 – PD-L1 303 – CD58 3650 (SEQ ID NO: 3688)
PD-L1 303 – CD155 665 – CTLA4 3037 – Fc (SEQ ID NO: 3664)
ICOSL 2264 – Fc
CTLA4 3037 – Fc
Belatacept
Fc CTLA4 3060 – CD155 665 – Fc (SEQ ID NO: 3652)
CD155 665 – CTLA4 3037 – Fc (SEQ ID NO: 3654)
CD155 665 – CD155 665 – ICOSL 2264 – ICOSL 2264 (SEQ ID NO: 3656)
CD155 665 – ICOSL 2264 – ICOSL 2264 (SEQ ID NO: 3658)
CD155 665 – CD58 3650 – Fc (SEQ ID NO: 3660)
CD58 3650 – CD155 665 – Fc (SEQ ID NO: 3662)
PD-L1 303 – CD155 665 – CTLA4 – Fc (SEQ ID NO: 3664)
CD155 665
ICOSL 2264 – Fc
CTLA4 3037 – Fc
Belatacept
Fc
CD58 3650 – Fc

MULTI-DOMAIN IMMUNOMODULATORY PROTEINS AND METHODS OF USE THEREOF

This application is a National Stage application under 35 U.S.C. § 371 of International Application No. PCT/US2019/012222, filed on Jan. 3, 2019 which claims priority from U.S. provisional patent application No. 62/613,378, filed Jan. 3, 2018, entitled "Multi-domain Immunomodulatory Proteins and Methods of Use Thereof," and to U.S. provisional application No. 62/733,622, filed Sep. 19, 2018, entitled "Multi-domain Immunomodulatory Proteins and Methods of Use Thereof," the contents of each of which are incorporated by reference in their entirety.

INCORPORATION BY REFERENCE OF SEQUENCE LISTING

The present application is being filed along with a Sequence Listing in electronic format. The Sequence Listing is provided as a file entitled 761612000700SUBSeqList.txt, created Jul. 28, 2020, which is 5,921 kilobytes in size. The information in the electronic format of the Sequence Listing is incorporated by reference in its entirety.

FIELD

The present disclosure provides multi-domain immunomodulatory proteins, nucleic acids encoding such immunomodulatory proteins, cells engineered to express the immunomodulatory proteins and infectious agents containing nucleic acid encoding the immunomodulatory proteins. The immunomodulatory proteins bind both an inhibitory receptor and a receptor involved in activation signaling cascades in an immune cell, such as a T cell. The immunomodulatory proteins, engineered cells and infectious agents provide therapeutic utility for a variety of immunological diseases or conditions. Compositions and methods for making and using such proteins are provided.

BACKGROUND

Modulation of the immune response by intervening in the processes that occur in the immunological synapse (IS) formed by and between antigen-presenting cells (APCs) or target cells and lymphocytes is of increasing medical interest. Currently, biologics used to enhance or suppress immune responses have generally been limited to immunoglobulins (e.g., anti-PD-1 antibodies) or soluble receptors against a single cell surface molecule (e.g., Fc-CTLA4). Improved therapeutic agents that can modulate the IS are needed. Provided are embodiments that meet such needs.

SUMMARY

Provided are immunomodulatory proteins containing at least one inhibitory receptor binding molecule (IRBM) that binds to an inhibitory receptor; and at least one activating receptor binding molecule (ARBM) that binds to (i) an activating receptor (ii) a ligand of the activating receptor, wherein the inhibitory receptor and the activating receptor are expressed on the same immune cell; the IRBM and ARBM are different polypeptides in which (a) one of the at least one of the IRBM or ARBM is a not an antibody or an antigen-binding antibody fragment; and/or (b) the at least one of the IRBM or the at least one of the ARBM contains a non-antibody immunoglobulin superfamily (IgSF) domain; and the IRBM exhibits higher binding activity, optionally higher binding affinity, for the inhibitory receptor than the ARBM exhibits for the activating receptor or a ligand of the activating receptor.

Provided are immunomodulatory proteins containing at least one inhibitory receptor binding molecule (IRBM) that binds to an inhibitory receptor; and at least one activating receptor binding molecule (ARBM) that binds to (i) an activating receptor or (ii) a ligand of an activating receptor, wherein the inhibitory receptor and the activating receptor are expressed on the same immune cell; the IRBM and ARBM are different polypeptides in which (a) one of the at least one of the IRBM or ARBM is a not an antibody or an antigen-binding antibody fragment; and/or (b) the at least one of the IRBM or the at least one of the ARBM contains a non-antibody immunoglobulin superfamily (IgSF) domain; and the immunomodulatory protein is a monomeric polypeptide and/or contains a single polypeptide chain.

In some of any of the provided embodiments, the ARBM binds to a ligand of an activating receptor. In some examples, the ligand of an activating receptor is CD80, CD86, ICOSL or an MHC molecule. In some embodiments, the ARBM binds to an activating receptor.

Provided are immunomodulatory proteins containing at least one inhibitory receptor binding molecule (IRBM) that binds to an inhibitory receptor; and at least one activating receptor binding molecule (ARBM) that binds to an activating receptor, wherein the inhibitory receptor and the activating receptor are expressed on the same immune cell; and the IRBM and ARBM are different polypeptides in which (a) one of the at least one of the IRBM or ARBM is a not an antibody or an antigen-binding antibody fragment; and/or (b) the at least one of the IRBM or the at least one of the ARBM contains a non-antibody immunoglobulin superfamily (IgSF) domain. In some of any such embodiments, the immune cell is a T cell.

In some of any of the provided embodiments, the activating receptor contains an immunoreceptor tyrosine-based activation motif (ITAM) or interacts with an adaptor protein comprising a binding domain specific to a phosphotyrosine residue. In some embodiments, the activating receptor is selected from a TCR, CD3, CD4, CD8, CD28, ICOS or CD2. In some embodiments, the activating receptor is CD28. In some embodiments, the activating receptor is CD2.

Provided are immunomodulatory proteins containing at least one inhibitory receptor binding molecule (IRBM) that binds to an inhibitory receptor, wherein the inhibitory receptor is PD-1 and at least one activating receptor binding molecule (ARBM) that binds to an activating receptor or to a ligand of the activating receptor, wherein the IRBM and ARBM are different polypeptides. Provided are immunomodulatory proteins containing at least one inhibitory receptor binding molecule (IRBM) that binds to an inhibitory receptor, wherein the inhibitory receptor is TIGIT and at least one activating receptor binding molecule (ARBM) that binds to an activating receptor or to a ligand of the activating receptor, wherein the IRBM and ARBM are different polypeptides. In some of any such embodiments, the activating receptor contains an immunoreceptor tyrosine-based activation motif (ITAM) or interacts with an adaptor protein comprising a binding domain specific to a phosphotyrosine residue. In some embodiments, the activating receptor is selected from a TCR, CD3, CD4, CD8, CD28, ICOS or CD2. In some examples, the activating receptor is CD28. In some embodiments, the activating receptor is CD2.

Provided are immunomodulatory proteins comprising at least one inhibitory receptor binding molecule (IRBM) that binds to an inhibitory receptor; and at least one activating receptor binding molecule (ARBM) that binds to an activating receptor or to a ligand of the activating receptor, wherein the activating receptor is CD28, wherein the IRBM and ARBM are different polypeptides.

Provided are immunomodulatory proteins comprising at least one inhibitory receptor binding molecule (IRBM) that binds to an inhibitory receptor; and at least one activating receptor binding molecule (ARBM) that binds to an activating receptor or to a ligand of the activating receptor, wherein the activating receptor is CD2, wherein the IRBM and ARBM are different polypeptides.

In some of any of the provided embodiments, the inhibitory receptor and the activating receptor are expressed on the same immune cell. In some embodiments, the immune cell is a T cell.

In some of any of the provided embodiments, one of the at least one of the IRBM or ARBM is a not an antibody or an antigen-binding antibody fragment; and/or the at least one of the IRBM or the at least one of the ARBM contains a non-antibody immunoglobulin superfamily (IgSF) domain.

In some of any of the provided embodiments, the IRBM exhibits higher binding activity, optionally higher binding affinity, for the inhibitory receptor than the ARBM exhibits for the activating receptor or a ligand of the activating receptor. In some embodiments, the IRBM exhibits 1.2-fold, 1.5-fold, 2.0-fold, 2.5-fold, 3.0-fold, 4.0-fold, 5.0-fold, 6.0-fold, 7.0-fold, 8.0-fold, 9.0-fold, 10.0 fold or higher binding activity, optionally higher binding affinity, for the inhibitory receptor than the ARBM exhibits for the activating receptor or a ligand of the activating receptor.

In some of any such embodiments, the at least one of the IRBM and the at least one of the ARBM is not an antibody or an antigen-binding antibody fragment. In some embodiments, the at least one of the IRBM or the at least one of the ARBM contains a non-antibody immunoglobulin superfamily (IgSF) domain. In some embodiments, the at least one of the IRBM and the at least one of the ARBM each individually contains at least one non-antibody IgSF domain.

In some of any of the provided embodiments, the ARBM binds to a ligand of the activating receptor and the ligand of the activating receptor is CD80 or CD86. In some embodiments, the ARBM is an antibody that specifically binds to the ligand of an activating receptor or is an antigen-binding antibody fragment. In some embodiments, the ARBM contains at least one IgSF domain of a binding partner of the ligand of the activating receptor. In some such embodiments, the binding partner of a ligand of an activating receptor is a wild-type CTLA-4 or is a variant thereof that binds to the ligand of the activating receptor, optionally wherein the ligand is CD80 or CD86. In some cases, the wild-type protein is a human protein. In some embodiments, the ARBM is not the full-length sequence of the binding partner; and/or the ARBM only contains the extracellular domain or an IgSF domain or specific binding fragment thereof of the binding partner. In some embodiments, the IgSF domain is an IgV domain. In some of any such embodiments, the binding partner of the ligand of an activating receptor is a CTLA-4 polypeptide or a variant thereof and the ARBM contains (i) the sequence of amino acids set forth in SEQ ID NO: 36, 2655 or 2947, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 36, 2655 2947; or (iii) a specific binding fragment of (i) or (ii). In some embodiments, the binding partner is a variant of a CTLA-4 polypeptide and the variant exhibits increased binding activity, optionally binding affinity, to the ligand of the activating receptor compared to the binding of unmodified or wild-type binding partner to the same ligand. In some cases, the binding activity, optionally binding affinity, to the ligand of the activating receptor is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

In some of any of the provided embodiments, the ARBM is an antibody that specifically binds to the activating receptor or is an antigen-binding antibody fragment.

In some of any of the provided embodiments, the ARBM contains at least one IgSF domain of a binding partner of the activating receptor. In some of any such embodiments, the ARBM is not the full-length sequence of the binding partner; and/or the ARBM only contains the extracellular domain or at least one IgSF domain or specific binding fragment thereof of the binding partner. In some embodiments, the IgSF domain is an IgV domain or an IgC domain. In some aspects, the at least one IgSF domain contains an IgV domain or specific binding fragment thereof, an IgC domain or a specific binding fragment thereof, or both. In some embodiments, the at least one IgSF domain consists of an IgV domain or specific binding fragment thereof, an IgC domain or a specific binding fragment thereof, or both.

In some embodiments, the activating receptor is CD28. In some embodiments, the binding partner of the activating receptor is selected from a wild-type ICOSL, CD80 or CD86 or is a variant thereof that binds to the activating receptor. In some cases, the wild-type protein is a human protein. In some of any such embodiments, the binding partner of the activating receptor is a ICOSL polypeptide or a variant thereof and the ARBM contains (i) the sequence of amino acids set forth in SEQ ID NO:32, 2056, or 2244, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 32, 2056, or 2244; or (iii) a specific binding fragment of (i) or (ii). In some of any such embodiments, the activating receptor is CD28 and the binding partner of the activating receptor is a CD80 polypeptide or a variant thereof and the ARBM includes (i) the sequence of amino acids set forth in SEQ ID NO: 28, 1005, 1079, 2615, 2654, or 3580, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO:28, 1005, 1079, 2615, 2654, or 3580; or (iii) a specific binding fragment of (i) or (ii). In some of any such embodiments, the binding partner of the activating receptor is a CD86 polypeptide or a variant thereof and the ARBM includes (i) the sequence of amino acids set forth in SEQ ID NO: 29 or 1195, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO:29 or 1195; or (iii) a specific binding fragment of (i) or (ii).

In some embodiments, the activating receptor is CD2. In some embodiments, the binding partner of the activating receptor is CD58 or is a variant thereof that binds to the activating receptor. In some cases, the wild-type protein is a human protein. In some of any such embodiments, the binding partner of the activating receptor is a CD58 polypeptide or a variant thereof and the ARBM includes (i) the sequence of amino acids set forth in SEQ ID NO: 2946, 3239 or 3650, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO:2946, 3239 or 3650; or (iii) a specific binding fragment of (i) or (ii).

In some of any such embodiments, the binding partner is a variant of the activating receptor and the variant exhibits increased binding activity, optionally binding affinity, to the activating receptor compared to the binding of unmodified or wild-type binding partner to the same activating receptor. In some examples, the binding activity, optionally binding affinity, to the activating receptor is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

In some of any of the provided embodiments, the inhibitory receptor includes an immunoreceptor tyrosine-based inhibitory motif (ITIM). In some embodiments, the inhibitory receptor is PD-1, TIGIT or CTLA-4. In some embodiments, the IRBM is an antibody that specifically binds to the inhibitory receptor or is an antigen-binding antibody fragment. In some embodiments, the IRBM contains at least one IgSF domain of a binding partner of the inhibitory receptor. In some examples, the binding partner of the inhibitory receptor is selected from a wild-type CD112, CD155, PD-L1 or PD-L2 or is a variant thereof that binds to the inhibitory receptor. In some instances, the wild-type protein is a human protein.

In some embodiments, the IRBM is not the full-length sequence of the binding partner; and/or the IRBM only contains the extracellular domain or an IgSF domain or specific binding fragment thereof of the binding partner, optionally wherein the IgSF domain is an IgV domain or an IgC domain. In some aspects, the at least one IgSF domain includes an IgV domain or specific binding fragment thereof, an IgC domain or a specific binding fragment thereof, or both. In some embodiments, the at least one IgSF domain consists of an IgV domain or specific binding fragment thereof, an IgC domain or a specific binding fragment thereof, or both.

In some of any such embodiments, the inhibitory receptor is a TIGIT. In some embodiments, the binding partner of the inhibitory receptor is a CD155 polypeptide or a variant thereof and the IRBM contains (i) the sequence of amino acids set forth in SEQ ID NO: 47, 310 or 353, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 47, 310 or 353; or (iii) a specific binding fragment of (i) or (ii). In some embodiments, the binding partner of the inhibitory receptor is a CD112 polypeptide or a variant thereof and the IRBM includes (i) the sequence of amino acids set forth in SEQ ID NO: 48, 666 or 761, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 48, 666 or 761; or (iii) a specific binding fragment of (i) or (ii).

In some of any such embodiments, the inhibitory receptor is PD-1. In some embodiments, the binding partner of the inhibitory receptor is a PD-L1 polypeptide or a variant thereof and the IRBM includes (i) the sequence of amino acids set forth in SEQ ID NO: 30, 55, 309 or 1728, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 30, 55, 309 or 1728; or (iii) a specific binding fragment of (i) or (ii). In some embodiments, the binding partner of the inhibitory receptor is a PD-L2 polypeptide or a variant thereof and the IRBM includes (i) the sequence of amino acids set forth in SEQ ID NO: 31, 1203 or 1263, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 31, 1203 or 1263; or (iii) a specific binding fragment of (i) or (ii).

In some of any of the provided embodiments, the IRBM contains at least one IgSF domain of a binding partner of the inhibitory receptor. In some of any of the provided embodiments, the IRBM is not the full-length sequence of the binding partner; and/or the IRBM only contains the extracellular domain or an IgSF domain or specific binding fragment thereof of the binding partner. In some embodiments, the IgSF domain is an IgV domain or an IgC domain. In some embodiments, the at least one IgSF domain contains an IgV domain or specific binding fragment thereof, an IgC domain or a specific binding fragment thereof, or both. In some embodiments, the at least one IgSF domain consists of an IgV domain or specific binding fragment thereof, an IgC domain or a specific binding fragment thereof, or both.

In some of any of the provided embodiments, the inhibitory is PD-1 and the binding partner of the inhibitory receptor is selected from a wild-type PD-L1 or PD-L2 or is a variant thereof that binds to the inhibitory receptor. In some cases, the wild-type protein is a human protein. In some embodiments, the binding partner of the inhibitory receptor is a PD-L1 polypeptide or a variant thereof and the IRBM includes (i) the sequence of amino acids set forth in SEQ ID NO: 30, 55, 309 or 1728, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 30, 55, 309 or 1728; or (iii) a specific binding fragment of (i) or (ii); or the binding partner of the inhibitory receptor is a PD-L2 polypeptide or a variant thereof and the IRBM includes (i) the sequence of amino acids set forth in SEQ ID NO: 31, 1203 or 1263, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 31, 1203 or 1263; or (iii) a specific binding fragment of (i) or (ii).

In some of any of the provided embodiments, the inhibitory is TIGIT and the binding partner of the inhibitory receptor is selected from a wild-type CD155 or CD112 or is a variant thereof that binds to the inhibitory receptor. In some cases, the wild-type protein is a human protein. In some embodiments, the binding partner of the inhibitory receptor is a CD155 polypeptide or a variant thereof and the IRBM contains (i) the sequence of amino acids set forth in SEQ ID NO: 47, 310 or 353, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 47, 310 or 353; or (iii) a specific binding fragment of (i) or (ii). In some embodiments, the binding partner of the inhibitory receptor is a CD112 polypeptide or a variant thereof and the IRBM includes (i) the sequence of amino acids set forth in SEQ ID NO: 48, 666 or 761, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 48, 666 or 761; or (iii) a specific binding fragment of (i) or (ii).

In some of any such embodiments, the binding partner is a variant and the variant exhibits increased binding activity, optionally binding affinity, to the inhibitory receptor compared to the binding of unmodified or wild-type binding partner to the same inhibitory receptor. In some examples, the binding activity, optionally binding affinity, to the inhibitory receptor is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

In some of any of the provided embodiments, the ARBM binds to an activating receptor that is CD28 and the IRBM binds to an inhibitory receptor that is PD-1. In some of any of the provided embodiments, the ARBM binds to an activating receptor that is CD28 and the IRBM binds to an inhibitory receptor that is TIGIT.

In some of any of the provided embodiments, the ARBM binds to an activating receptor that is CD28 and the ARBM contains at least one IgSF domain of a binding partner of CD28.

In some of any such embodiments, the binding partner of CD28 is ICOSL or is a variant thereof that binds to CD28. In some aspects, the binding partner is a variant of ICOSL and the variant exhibits increased binding activity, optionally binding affinity, to CD28 compared to the binding of unmodified or wild-type ICOSL to CD28. In some embodiments, the binding activity, optionally binding affinity, to CD28 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold. In some embodiments, the ARBM contains (i) the sequence of amino acids set forth in SEQ ID NO: 32, 2056, or 2244, (ii) a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 32, 2056, or 2244; or (iii) a specific binding fragment of (i) or (ii). In some of any such embodiments, the ARBM is a variant ICOSL and the one or more amino acid modifications in a variant ICOSL can be any described herein, such as set forth in Section I.B.1.a. In some embodiments, the one or more amino acid modifications include any set forth in Table 7. In some embodiments, the ARBM is a variant ICOSL and the variant ICOSL contains one or more amino acid modifications at one or more position corresponding to 52, 57, 100, 110, or 198 with reference to numbering set forth in SEQ ID NO: 32, 2056, or 2244. In some cases, the variant ICOSL contains one or more amino acid modifications selected from N52H, N52D, N52S, N52K, S54A, S54P, N57Y, Q100P, Q100R, V110A, V110D, C198R, or a conservative amino acid substitution thereof, with reference to numbering set forth in SEQ ID NO: 32, 2056, or 2244. In some embodiments, the variant ICOSL contains one or more amino acid modifications selected from M10V, M10I, V11E, S13G, E16V, S18R, A20V, S25G, F27S, F27C, N30D, Y33del, Q37R, K42E, T43A, Y47H, N52A, N52C, N52D, N52G, N52H, N52L, N52K, N52M, N52P, N52Q, N52R, N52S, N52T, N52V, N52Y, S54A, S54P, N57A, N57E, N57F, N57H, N57K, N57L, N57M, N57P, N57Q, N57S, N57T, N57V, N57W, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100A, Q100D, Q100E, Q100G, Q100K, Q100L, Q100M, Q100N, Q100R, Q100P, Q100S, Q100T, Q100V, L102R, G103E, V107A, V107I, S109G, 5109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140D, C140del, 5142F, I143V, I143T, N144D, Y146C, V151A, Y152C, Y152H, W153R, I154F, N155H, N155Q, K156M, D158G, L161P, L161M, L166Q, N168Q, F172S, L173S, M175T, T1905, T190A, S192G, V193M, N194D, C198R, N201S, L203P, L203F, N207Q, L208P, V210A, S212G, D217V, I218T, 1218N, E220G, R221G, R221I, I224V, T225A, N227K or a conservative amino acid modification thereof, with reference to numbering of reference to numbering of SEQ ID NO:32, 2056 or 2244.

In some of any such embodiments, the variant ICOSL polypeptide contains the amino acid modification(s) N52S, N52S, N52D, N52Y/N57Y/F138L/L203P, N52H/N57Y/Q100P, N52S/Y146C/Y152C, N52H/C198R, N52H/C140del/T225A, N52H/C198R/T225A, N52H/K92R, N52H/S99G, N57Y, N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, S54A, N52D/S54P, N52K/L208P, N52S/Y152H, N52H/I143T, N52S/L80P, N52S/D158G, N52D/Q133H, N52H/N57Y/Q100R/V110D/C198R/S212G, N52H/N57Y/Q100R/C198R, N52H/N57Y/L74Q/V110D/S192G, N52H/Q100R, N52H/S121G/C198R, A20V/N52H/N57Y/Q100R/S109G, N52H/N57Y/Q100P/C198R, N52H/N57Y/Q100R/V122A, N52H/N57Y/Q100R/F172S, N52H/N57Y/Q100R, N52S/F120S/N227K, N52S/N194D, N52S/F120S, N52S/G72R, N52S/A71T/A117T/T190A/C198R, N52H/N57Y/Q100R/V107I/V110D/S132F/I154F/C198R/R221G, E16V/N52H/N57Y/Q100R/V110D/H115R/Y152C/K156M/C198R, N52H/N57Y/Q100R/V110D/C198R, F27S/N52H/N57Y/V110N, N52S/H94E/L96I/S109N/L166Q, S18R/N52S/F93L/I143V/R221G, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N52H/N57Y/Q100R/V110D/F172S/C198R, S25G/F27C/N52H/N57Y/Q100R/V110D/E135K/L173S/C198R, N52H/N57Y/V110A/C198R/R221I, N52H/N57Y/Q100R/L102R/V110D/H115R/C198R, N52H/N57Y/Q100R/V110D/N144D/F172S/C198R, N52S/H94E/L98F/Q100R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/H115X/F172S/C198R, N52H/Q100R/H115R/F172S/C198R, N52H/N57Y/Q100R/F172S/C198R, N52H/N57Y/Q100R/H115R/F172S/C198R, N52H/N57Y/Q100R/H115R/F172S, Q100R, N52Y/F138L/L203P, N57Y/Q100R/C198R, N57Y/F138L/L203, N52H, N57Y, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/N57Y/Q100R/H115R/F172S/N194D, N52H/N57Y/H115R/F172S/C198R, N52H/N57Y/Q100R/H115R/C198R, N52H/N57Y/H115R, N52H/Q100R/H115R/I143T/F172S, N52H/N57Y/Q100P/H115R/F172S, E16V/N52H/N57Y/Q100R/V110D/H115R/C198R, N30D/K42E/N52S/H115R/C198R/R221I, N52S/E90A/H115R, N30D/K42E/N52S/H115R, N52S/H115R/F172S/C198R, N119Q, N207Q, N52Q/N207X, N168X/N207X, N52Q/N168Q, N84Q/N207Q, N119Q/N168Q, N119Q/N207Q, N119Q/N155X, N52Q/N119Q, N52Q/N84Q/N207Q, N119Q/N155Q/N168Q, N52Q/N84Q/N155X/N168X, N52Q/N84Q/N119Q/N168Q, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57L/Q100S, N52R/N57W/Q100K, N52R/N57W, N52G/N57V, N52L/N57V, N52S/N57L/Q100G, N52T/N57K/Q100P. In some cases, the variant ICOSL polypeptide contains the modification(s) N52H/N57Y/Q100R/F172S, N52H/N57Y/Q100R, N52H/N57Y/Q100R/V122A, N52H/Q100R, N52H/N57Y/Q100P, N52H/N57Y/V110A/C198R/R221I, N52Y/N57Y/I38L/L203P, N52S/N194D or N52D.

In some of any of the provided embodiments, the ARBM contains the sequence of amino acids set forth in any of SEQ ID NOs: 2022-2055, 2074, 2076-2121, 2137-2154, 2160-2197, 2200-2206, 2208-2243, 2299-2346, or a specific binding fragment thereof. In some of any of the provided embodiments, the ARBM includes the sequence of amino acids set forth in any of SEQ ID NOs: 2057-2073, 2075, 2122-2136, 2155-2159, 2189-2199, 2207, 2245-2298, 2347-2518, or a specific binding fragment thereof.

In some of any of the provided embodiments, the binding partner of CD28 is CD80 or CD86. In some embodiments, the ARBM contains (i) the sequence of amino acids set forth in SEQ ID NO: 28, 1005, 1079, 2615, 2654 or 3580, (ii) a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 28, 1005, 1079, 2615, 2654 or 3580; or (iii) a specific binding fragment of (i) or (ii). In some of any of the provided embodiments, the ARBM includes (i) the sequence of amino acids set forth in SEQ ID NO: 29 or 1195, (ii) a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 29 or 1195; or (iii) a specific binding fragment of (i) or (ii). In some of any such embodiments, the ARBM is a variant CD80 and the one or more amino acid modifications can include any described herein, such as set forth in Section I.B.1.b. In some embodiments, the one or more amino acid modifications include any set forth in Table 8. In some of any such embodiments, the ARBM is a variant CD86 and the one or more amino acid modifications can be any described herein, such as set forth in Section I.B.1.c. In some embodiments, the one or more amino acid modifications include any set forth in Table 9.

In some of any of the provided embodiments, the ARBM binds to an activating receptor that is CD28 and the IRBM binds to an inhibitory receptor that is PD-1. In some of any of the provided embodiments, the ARBM binds to an activating receptor that is CD28 and the IRBM binds to an inhibitory receptor that is TIGIT.

In some of any of the provided embodiments, the ARBM binds to an activating receptor that is CD2 and the ARBM contains at least one IgSF domain of a binding partner of CD2. In some embodiments the binding partner of CD2 is CD58 or is a variant thereof.

In some of any of the provided embodiments, the ARBM comprises (i) the sequence of amino acids set forth in SEQ ID NO: 2946, 3239 or 3650, (ii) a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 2946, 3239 or 3650; or (iii) a specific binding fragment of (i) or (ii). In some embodiments, the binding partner of CD2 is a wild-type human CD58. In some embodiments, the ARBM is set forth in SEQ ID NO:2946, 3239 or 3650 or is a specific binding fragment thereof that binds to CD2.

In some of any of the provided embodiments, the ARBM binds to a ligand of an activating receptor that is CD80 or CD86 and the IRBM binds to an inhibitory receptor that is PD-1. In some embodiments, the ARBM contains at least one IgSF domain of a binding partner of the ligand of the activating receptor. In some examples, the binding partner is CTLA-4 or is a variant thereof that binds to CD80 or CD86. In some of any such embodiments, the binding partner is a variant of CTLA-4 and the variant exhibits increased binding activity, optionally binding affinity, to CD80 or CD86 compared to the binding of unmodified or wild-type CTLA-4 to CD80 or CD86. In some cases, the binding activity, optionally binding affinity, to CD80 or CD86 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold. In some embodiments, the ARBM contains (i) the sequence of amino acids set forth in SEQ ID NO: 36, 2655 or 2947, (ii) a sequence of amino acids that has at least 85%, 86%, 87%, 88%, 89%, 90%, 91%, 92%, 93%, 94%, 95%, 96%, 97%, 98%, or 99% sequence identity to SEQ ID NO: 36, 2655 or 2947; or (iii) a specific binding fragment of (i) or (ii). In some of any such embodiments, the ARBM is a variant CTLA-4 and the one or more amino acid modifications can include any described herein, such as set forth in Section I.B.5.b. In some embodiments, the one or more amino acid modifications include any set forth in Table 10. In some embodiments, the variant CTLA-4 contains one or more modification at one or more position selected from 6, 10, 12, 14, 15, 16, 18, 19, 20, 22, 24, 26, 27, 28, 29, 30, 31, 33, 35, 37, 38, 41, 42, 43, 45, 46, 47, 48, 53, 54, 55, 56, 58, 59, 61, 63, 64, 65, 67 69, 71, 72, 73, 75, 76, 82, 85, 86, 87, 89, 91, 93, 95, 96, 97, 98, 99, 105, 106, 108, 110, 113, 115, 116, 117, 118, 119, 120, 121 or 122 with reference to numbering set forth in SEQ ID NO:36 or 2655. In some embodiments, the variant CTLA-4 contains one or more amino acid modifications selected from A6T, V10A, L12F, L12H, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, A31Y, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V96I, E97Q, L98Q, L98R, M99I, M99L, Y105F, Y105L, L106E, L106I, L106R, I108F, I108V, N110K, N110S, N110Y, Y115N, V116A, I117E, I117L, I117M, I117T, I18T, or I18V, or a conservative amino acid substitution thereof, with reference to numbering set forth in SEQ ID NO: 36 or 2655.

In some of any such embodiments, the variant CTLA-4 contains the amino acid modification(s) A31Y/L106E, A6T/A26T/M55T/M99L/Y105L, V10A/G29W/T53S/M56K/L63P/L98Q/Y105L/P121S, V10A/L63P/D64V/S72G/L98Q/M99L/Y105L, V10A/L63P/L98Q/Y105L, L12F/R16H/G29W/M56T/L98Q/Y105L, L12F/A26T/L63P/L98Q/Y105L/L106R, L12F/K30R/S72G/Q82R/L98Q/M99L/Y105L, L12H/I18V/A42T/M55T/N58D/L98R/Y105L/L106I/P121S, L12H/E33M/L98Q/Y105L, L12H/

M55T/E59D/L63P/M99L, L12H/L63P/S72G/L98Q/Y105L, L12I/M55T/M56V/I67T/M99L/L106R/I108F, L12P/R16H/A26T/T61S/L63P/M87V/L98Q/M99L/Y105L/L106I/I117L, L12P/I18T/A26T/M55T/T69S/S72G/M99L/Y105L, L12P/A26T, L12P/A26T/L63P, L12P/A26T/L63P/S72G/T89M/L98Q/M99L/Y105L, L12P/G29W/L63P/S72G/L98Q/Y105L, L12P/G29W/L63P/S72G/L98Q/Y105L/L106I, L12P/A26T/L63P/L98Q/M99L/Y105L, L12P/A26T/L63P/L98Q/Y105L, L12P/A26T/L63P/L98Q/Y105L/L106I, L12P/G29W/D43N/N58S/L63P/L98Q/M99L/Y105L, L12P/M56V/L63P/V96I/L98Q/M99L/Y105L/Y115H, L12P/L63P/S72G/L98Q/M99L/Y105L, L12P/L63P/S72G/L98Q/M99L/Y105L/L106N, L12P/L63P/S72G/L98Q/M99L/Y105L/L106N/I117L, S14N/R16C/I18T/M56K/T61A/L63P/A86T/M99L, S15P/I18V/M56T/L98Q/M99L/Y105L, R16C/G29W/E33V/M55T/L63P/L98Q/Y105L, I18A/L63P/S72G/L98Q/Y105L, I18F/L63P/L98Q/M99L/Y105L/P121S, I18N/A26T/L63H/T89A/L98Q/M99L/Y105L, I18N/L63P/S72T/M87T/L98Q/Y105L/N110S, I18T/A26S/M55T/M56V/L63P/S72G/L98Q/M99L/Y105L/I117K, I18T/A26T/L63P/S72G/L98Q/Y105L, I18T/A26T/L63P/Q82R/L98Q/Y105L, I18T/G29R/L63P/S72G/L98Q/M99L/Y105L, I18T/G29W/L63P/L98Q/Y105L, I18T/E48R/L63P/T69S/L98Q/Y105L/N110Y, I18T/T61R/L63P/S72G/L98Q/M99L/Y105L, I18T/L63P/S72G/M87K/L98Q/M99L/Y105L, I18T/L63P/S72G/L98Q/M99L/Y105L, I18T/L63P/S72G/L98Q/Y105L/I108V, I18V/A26T/L63P/D64E/L98Q/Y105L/L106R/N110K, I18V/G29W/L63P/S72G/L98Q/Y105L, A19V/G29W/R35K/L63P/L98Q/M99L/Y105L, S20N/A26T/L63P/L98Q/M99L/Y105L, V22A/L63P/L98Q/M99L/Y105L/P119H, V22I/L63P/L98Q/Y105L/I117M, E24Q/L63P/S72G/L98Q/M99L/Y105L, A26D/S72G/L98Q/M99L/Y105L, A26T/A42V/Q45H/I67N/M87K/E97Q/M99L, A26T/V46E/L63P/D65G/L98Q, A26T/T47A/M56K/L63P/S72G/Q82R/L98Q/M99L/Y105L, A26T/T53S/M56K/L63P/L98Q/Y105L, A26T/T53S/L63P/L98Q/Y105L/L106I/I117L, A26T/Y54F/M56K/M99L/Y105L, A26T/M55R/L98Q/M99L/Y105L, A26T/M55T/L63P/S72G/L98Q/M99L/Y105L, A26T/M55T/L63P/L98Q/M99L/Y105L, A26T/L63P/D65G/L98Q/M99L/Y105L, A26T/L63P/M87V/N110K/I117E, A26T/L63P/S72G/L98Q/M99L/Y105L, A26T/L63P/S72G/L98Q/Y105L/L106I/I117L, A26T/L63P/L98Q/M99L/Y105L, A26T/I67N/S72G/L98Q/M99L/Y105L, S27P/M56K/L63P/S72G/S73R/T89A/M99L/Y105L/I117M, P28L/E33V/L63P/S72G/L98Q/M99L/Y105L, P28L/E33V/L63P/S72G/L98R/M99L/Y105L, G29W/T53S/M56K/N58S/L63P/M87V/L98Q/Y105L, G29W/T53S/M56K/N58S/L63P/M87V/L98Q/Y105L/I108V, G29W/T53S/M56K/N58S/L63P/M87V/L98Q/Y105L/P121S, G29W/T53S/M56K/T61N/L63P/L98Q/Y105L, G29W/T53S/M56K/L63P/Q82H/L98Q/M99I/Y105L, G29W/T53S/M56K/L63P/L98Q/Y105L, G29W/T53S/L63P/S72G/L98Q/Y105L, G29W/M55V/E59G/L63P/L98Q/Y105L, G29W/M56T/L63P/L98Q/Y105L/L106I/I117L, G29W/N58D/I67V/L98Q/M99L/Y105L, G29W/N58S/L63P/D64N/L98Q/M99L/Y105L, G29W/N58S/L63P/T69I/L98Q/M99L/Y105L, G29W/N58S/L63P/S72G/L98Q/Y105L, G29W/N58S/L63P/S72G/L98Q/Y105L/L106I, G29W/N58S/L63P/S72G/L98Q/Y105L/L106V, G29W/N58S/L63P/S72G/M87V/L98Q/Y105L, G29W/N58S/L63P/Q82R/L98Q/Y105L, G29W/N58S/L63P/M87T/L98Q/M99L/Y105L, G29W/N58S/L63P/L98Q/Y105L, G29W/E59G/L63P/L98Q/Y105L, G29W/T61I/L63P/S72G/L98Q/M99L/Y105L, G29W/L63P/D65G/S72G/L98Q/Y105L, G29W/L63P/I67V/S72G/L98Q/Y105L, G29W/L63P/S72G/L98Q/Y105L/L106I, G29W/L63P/S72G/L98Q/Y105L/L106I/I117L, G29W/L63P/S72G/L98Q/Y105L/I117L, G29W/L63P/S72G/L98Q/Y105L/P121S, G29W/L63P/L98Q/M99L/Y105L, G29W/S72G/Q76R/L98Q/Y105L/L106I/Q113H, G29W/M87K/T89S/L98Q/M99L/Y105L/I108V/I117L, G29W/M87K/I93V/L98Q/M99L/Y105L, G29W/L98Q/M99L/Y105L, E33M/A42T/L98Q/Y105L, E33M/L63P/S72G/L98Q/Y105L, E33M/L63P/S72G/L98Q/Y105L/I108F, E33M/L63P/S72G/L98Q/Y105L/I117L, E33M/Q82H/L98Q/M99L/Y105L, E33V/A42S/M55T/L98Q/M99L/Y105L, T37S/M56V/L98Q/Y105L, V38I/L63P/S72G/L98Q/M99L/Y105L, Q41L/Y54F/M56K/M99L/I108F, T53S/M56V/L98Q/Y105L, M55T/L63P/T71I/M99L/Y105L, M55T/S72G/L98Q/M99L/Y105L, M55T/E97Q/M99L/Y105F, M56K/L63P/N75D/V96I/M99L/Y105L/L106I, M56L/L63P/L98Q/Y105L/L106I/I117L, M56R/L63P/L98Q/M99L/Y105L, M56T/L91R/L98Q/Y105L, M56V/E59G/L63P/S72G/M87K/I93V/L98Q/M99L/Y105L/I117E, T61A/L63P/S72G/L98Q/M99L/Y105L, L63P/T69A/L98Q/M99L/Y105L/L106R/V116A, L63P/S72G/M87A/L98Q/Y105L, L63P/S72G/I93L/L98Q/M99L/Y105L, L63P/S72G/L98Q/M99L/Y105L, L63P/S72G/L98Q/M99L/Y105L/L106I/I117L, L63P/S72G/L98Q/Y105L, L63P/S72G/L98Q/Y105L/L106I/I117L, L63P/S72G/Y105L, L63P/M87K/M99L/L106R, L63P/Q82H/L98Q/M99L/Y105L, L63P/K95R, L63P/L98Q, L63P/L98Q/M99L/Y105L, L63P/L98Q/M99L/Y105L/L106I, L63P/L98Q/M99L/Y105L/I108V, L63P/L98Q/M99L/Y105L/I117M, L63P/L98Q/Y105L, L63P/L98Q/V116A, L63P/L98R/N110K, L63P/M99L/Y105L/I108F, I67V/S72G/Q82H/T89A/L98Q/M99L/Y105L, S72G/R85G/L98Q/M99L/Y105L/L106I, S72G/L98Q/M99L/Y105L/I117T, L98Q/M99L/Y105L, L98Q/M99L/Y105L/L106I/I117T, L98Q/M99L/Y105L/L106I/Y115N, L98Q/Y105L, and L98R/N110K, with reference to numbering set forth in SEQ ID NO:36 or 2655. In some embodiments, the variant CTLA-4 polypeptide contains the modification(s) A31Y/L106E, with reference to numbering set forth in SEQ ID NO:36 or 2655.

In some of any of the provided embodiments, the ARBM includes the sequence of amino acids set forth in any of 2519, 2520, 2948-3041, 3043-3048, 3050-3099, 3230, 3231, or a specific binding fragment thereof. In some of any of the provided embodiments, the ARBM includes the sequence of amino acids set forth in any of SEQ ID NOs: 3100-3229, 3232 or 3233, or a specific binding fragment thereof.

In some of any of the provided embodiments, the IRBM contains at least one IgSF domain of a binding partner of PD-1. In some embodiments, the binding partner of PD-1 is PD-L1 or PD-L2 or is a variant of PD-L1 or PD-L2 that binds to PD-1. In some embodiments, the binding partner is a variant of PD-L1 or PD-L2 and the variant exhibits increased binding activity, optionally binding affinity, to PD-1 compared to the binding of unmodified or wild-type PD-L1 or PD-L2, respectively, to PD-1. In some embodiments, the binding activity, optionally binding affinity, to PD-1 is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold. In some embodiments, the IRBM contains (i) the sequence of amino acids set forth in SEQ ID NO: 30, 55, 309 or 1728, (ii) a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 30, 55, 309 or 1728; or (iii) a specific binding fragment of (i) or (ii). In some embodiments, the IRBM includes (i) the sequence of amino acids set forth in SEQ ID NO: 31, 1203 or 1263, (ii)

a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 31, 1203 or 1263; or (iii) a specific binding fragment of (i) or (ii). In some of any such embodiments, the one or more amino acid modifications is a variant PD-L1 and can include any described herein, such as set forth in Section I.A.1.a. In some embodiments, IRBM is a variant PD-L1 and the one or more amino acid modifications include any set forth in Table 2. In some of any such embodiments, the IRBM is a variant PD-L2 and the one or more amino acid modifications can include any described herein, such as set forth in Section I.A.1.b. In some embodiments, the one or more amino acid modifications include any set forth in Table 3.

In some of any such embodiments, the IRBM is a variant of PD-L1 and the variant PD-L1 contains one or more amino acid modifications at one or more positions corresponding to 6, 10, 11, 14, 15, 16, 17, 18, 19, 20, 22, 23, 26, 27, 28, 33, 35, 36, 40, 41, 43, 44, 45, 46, 47, 49, 50, 51, 52, 53, 54, 55, 56, 57, 58, 60, 64, 65, 68, 71, 72, 73, 74, 75, 78, 79, 83, 85, 89, 90, 93, 97, 98, 99, 101, 102, 103, 104, 106, 110, 111, 112, 113, 117, 119, 120, 121, 124, 129, 130, 131, 134, 137, 138, 144, 148, 149, 150, 155, 158, 160, 163, 165, 167, 170, 171, 173, 175, 176, 177, 179, 180, 183, 185, 188, 189, 192, 193, 194, 195, 196, 197, 198, 199, 200, 201, 202, 203, 204, 206, 207, 213, or 221, with reference to numbering set forth in SEQ ID NO: 30, 309 or 1728. In some of any such embodiments, the variant PD-L1 contains one or more amino acid modifications selected from P6S, Y10F, V11A, V11E, Y14S, G15A, S16G, N17D, M18I, M18T, M18V, T19A, T19I, I20L, C22R, K23E, K23N, K23R, E26A, E27D, E27G, K28E, K28I, K28N, K28R, A33D, L35P, I36S, I36T, E40G, M41K, M41V, D43G, D43V, K44E, N45D, N45I, N45T, I46V, I47T, F49S, V50A, H51N, H51R, H51Y, G52R, G52V, E53G, E53V, E54G, D55G, D55N, D55S, D55V, L56Q, K57E, K57R, V58A, V58D, H60R, R64S, Q65L, R68L, K71E, D72G, Q73R, L74P, S75P, N78I, N78S, A79T, I83T, D85E, Q89R, D90G, V93E, M97I, M97K, M97L, I98L, I98T, I98V, S99G, G101D, G101G-ins (G101GG), G102D, A103V, D104G, K106E, K106R, V110M, K111E, K111T, V112A, N113Y, N117S, 1119T, N120S, Q121L, L124S, V129A, V129D, T130A, S131F, E134G, C137R, Q138R, K144E, K144Q, I148V, W149R, T150A, Q155H, S158G, K160M, T163I, K163N, N165Y, K167R, K167T, E170G, K171R, F173I, F173L, K173Y, V175A, S177C, L179P, R180S, T183A, T183I, T185A, I188V, F189L, F189S, T192S, F193S, R194G, R194W, R195G, R195S, R195T, L196S, D197G, P198S, P198T, E199G, E200K, E200N, N201D, N201Y, H202Q, T203A, A204T, L206F, V207A, L213P, or T221L or a conservative amino acid substitution thereof, with reference to numbering set forth in SEQ ID NO: 30, 309 or 1728.

In some embodiments, the variant PD-L1 polypeptide contains the amino acid modification(s) K28N/M41V/N45T/H51N/K57E, I20L/I36T/N45D/I47T, I20L/M41K/K44E, P6S/N45T/N78I/I83T, N78I, M41K/N78I, N45T/N78I, I20L/N45T, N45T, M41K, I20L/I36T/N45D, N17D/N45T/V50A/D72G, I20L/F49S, N45T/V50A, I20L/N45T/N78I, I20L/N45T/V50A, M41V/N45T, M41K/N45T, A33D/S75P/D85E, M18I/M41K/D43G/H51R/N78I, V11E/I20L/I36T/N45D/H60R/S75P, A33D/V50A, S16G/A33D/K71E/S75P, E27G/N45T/M97I, E27G/N45T/K57R, A33D/E53V, D43G/N45D/V58A, E40G/D43V/N45T/V50A, Y14S/K28E/N45T A33D/N78S, A33D/N78I, A33D/N45T, A33D/N45T/N78I, E27G/N45T/V50A, N45T/V50A/N78S, I20L/N45T/V110M, I20L/I36T/N45T/V50A, N45T/L74P/S75P, N45T/S75P, S75P/K106R, S75P, A33D/S75P, A33D/S75P/D104G, A33D/S75P, I20L/E27G/N45T/V50A, I20L/E27G/D43G/N45D/V58A/N78I, I20L/D43G/N45D/V58A/N78I, I20L/A33D/D43G/N45D/V58A/N78I, I20L/D43G/N45D/N78I, E27G/N45T/V50A/N78I, N45T/V50A/N78I, V11A/I20L/E27G/D43G/N45D/H51Y/S99G, I20L/E27G/D43G/N45T/V50A, I20L/K28E/D43G/N45D/V58A/Q89R, I20L/I36T/N45D, I20L/K28E/D43G/N45D/E53G/V58A/N78I, A33D/D43G/N45D/V58A/S75P, K23R/D43G/N45D, I20L/D43G/N45D/V58A/N78I/D90G/G101D, D43G/N45D/L56Q/V58A/G101GG, I20L/K23E/D43G/N45D/V58A/N78I, I20L/K23E/D43G/N45D/V50A/N78I, T19I/E27G/N45I/V50A/N78I/M97K, I20L/M41K/D43G/N45D, K23R/N45T/N78I, I20L/K28E/D43G/N45D/V58A/Q89R/G101G-ins (G101GG), K57R/S99G, K57R/S99G/F189L, M18V/M97L/F193S/R195G/E200K/H202Q, I36S/M41K/M97L/K144Q/R195G/E200K/H202Q/L206F, C22R/Q65L/L124S/K144Q/R195G/E200N/H202Q/T221L, M18V/I98L/L124S/P198T/L206F, S99G/N117S/I148V/K171R/R180S, I36T/M97L/A103V/Q155H, K28I/S99G, R195S, A79T/S99G/T185A/R195G/E200K/H202Q/L206F, K57R/S99G/L124S/K144Q, K57R/S99G/R195G, D55V/M97L/S99G, E27G/I36T/D55N/M97L/K111E, E54G/M97L/S99G, G15A/I36T/M97L/K111E/H202Q, G15A/I36T/V129D, G15A/I36T/V129D/R195G, G15A/V129D, I36S/M97L, I36T/D55N/M97L/K111E/A204T, I36T/D55N/M97L/K111E/V129A/F173L, I36T/D55S/M97L/K111E/I148V/R180S, I36T/G52R/M97L/V112A/K144E/V175A/P198T, I36T/I46V/D55G/M97L/K106E/K144E/T185A/R195G, I36T/I83T/M97L/K144E/P198T, I36T/M97L/K111E, I36T/M97L/K144E/P198T, I36T/M97L/Q155H/F193S/N201Y, I36T/M97L/V129D, L35P/I36S/M97L/K111E, M18I/I36T/E53G/M97L/K144E/E199G/V207A, M18T/I36T/D55N/M97L/K111E, M18V/M97L/T176N/R195G, M97L/S99G, N17D/M97L/S99G, S99G/T185A/R195G/P198T, V129D/H202Q, V129D/P198T, V129D/T150A, V93E/V129D, Y10F/M18V/S99G/Q138R/T203A, N45D, K160M/R195G, N45D/K144E, N45D/P198S, N45D/P198T, N45D/R195G, N45D/R195S, N45D/S131F, N45D/V58D, V129D/R195S, I98T/F173Y/L196S, N45D/E134G/L213P, N45D/F173I/S177C, N45D/I148V/R195G, N45D/K111T/R195G, N45D/N113Y/R195S, N45D/N165Y/E170G, N45D/Q89R/I98V, N45D/S131F/P198S, N45D/S75P/P198S, N45D/V50A/R195T, E27D/N45D/T183A/I188V, F173Y/T183I/L196S/T203A, K23N/N45D/S75P/N120S, N45D/G102D/R194W/R195G, N45D/G52V/Q121L/P198S, N45D/I148V/R195G/N201D, N45D/K111T/T183A/I188V, N45D/Q89R/F189S/P198S, N45D/S99G/C137R/V207A, N45D/T163I/K167R/R195G, N45D/T183A/T192S/R194G, N45D/V50A/I119T/K144E, T19A/N45D/K144E/R195G, V11E/N45D/T130A/P198T, V26A/N45D/T163I/T185A, K23N/N45D/L124S/K167T/R195G, K23N/N45D/Q73R/T163I, K28E/N45D/W149R/S158G/P198T, K28R/N45D/K57E/I98V/R195S, K28R/N45D/V129D/T163N/R195T, M41K/D43G/N45D/R64S/R195G, M41K/D43G/N45D/R64S/S99G, N45D/R68L/F173L/D197G/P198S, N45D/V50A/I148V/R195G/N201D, M41K/D43G/K44E/N45D/R195G/N201D, or N45D/V50A/L124S/K144E/L179P/R195G, with reference to numbering set forth in SEQ ID NO: 30, 309 or 1728. In some embodiments, the variant PD-L1 contains the modification(s) D43G/N45D/L56Q/V58A/G101G-ins.

In some of any of the provided embodiments, the IRBM contains the sequence of amino acids set forth in any of SEQ ID NOs: 56-120, 1725, 1729-1818, 1819-1907, 1943-2008 or a specific binding fragment thereof. In some of any of the provided embodiments, the IRBM contains the sequence of amino acids set forth in any of SEQ ID NOs: 121-185, 244-308, 1726-1727, 1908-1937.

In some of any of the provided embodiments, the IRBM is a variant of PD-L2 and the variant PD-L2 contains one or more amino acid modifications at one or more positions corresponding to 2, 12, 13, 15, 18, 20, 23, 24, 28, 31, 32, 33, 36, 37, 39, 44, 45, 46, 47, 48, 58, 59, 65, 67, 69, 71, 72, 73, 74, 75, 76, 77, 82, 85, 86, 89, or 91, with reference to SEQ ID NO:31 and 1263. In some of any such embodiments, the variant PD-L2 contains one or more amino acid modifications selected from F2L, I12V, I13V, H15Q, N18D, T20A, N24S, C23S, G28V, N24D, V31A, V31M, N32D, L33P, L33H, L33F, I36V, T37A, S48C, S39I, E44D, N45S, D46E, T47A, E58G, E59G, K65R, S67L, H69L, P71S, Q72H, V73A, Q74R, R76G, D77N, Q82R, I85F, I86T, V89D, or W91R, with reference to numbering set forth in SEQ ID NO:31 and 1263. In some of any such embodiments, the variant PD-L2 contains the amino acid modification(s) H15Q, N24D, E44D, V89D, Q82R/V89D, E59G/Q82R, S39I/V89D, S67L/V89D, S67L/I85F, S67L/I86T, H15Q/K65R, H15Q/Q72H/V89D, H15Q/S67L/R76G, H15Q/R76G/I85F, H15Q/T47A/Q82R, H15Q/Q82R/V89D, H15Q/C23S/I86T, H15Q/S39I/I86T, E44D/V89D/W91R, I13V/S67L/V89D, H15Q/S67L/I86T, I13V/H15Q/S67L/I86T, I13V/H15Q/E44D/V89D, I13V/S39I/E44D/Q82R/V89D, I13V/E44D/Q82R/V89D, I13V/Q72H/R76G/I86T, I13V/H15Q/R76G/I85F, H15Q/S39I/R76G/V89D, H15Q/S67L/R76G/I85F, H15Q/T47A/Q72H/R76G/I86T, H15Q/T47A/Q72H/R76G, I13V/H15Q/T47A/Q72H/R76G, H15Q/E44D/R76G/I85F, H15Q/S39I/S67L/V89D, H15Q/N32D/S67L/V89D, N32D/S67L/V89D, H15Q/S67L/Q72H/R76G/V89D, H15Q/Q72H/Q74R/R76G/I86T, G28V/Q72H/R76G/I86T, I13V/H15Q/S39I/E44D/S67L, E44D/S67L/Q72H/Q82R/V89D, H15Q/V89D, H15Q/T47A, I13V/H15Q/Q82R, I13V/H15Q/V89D, I13V/S67L/Q82R/V89D, I13V/H15Q/Q82R/V89D, H15Q/V31M/S67L/Q82R/V89D, I13V/H15Q/T47A/Q82R, I13V/H15Q/V31A/N45S/Q82R/V89D, H15Q/T47A/H69L/Q82R/V89D, I13V/H15Q/T47A/H69L/R76G/V89D, I12V/I13V/H15Q/T47A/Q82R/V89D, I13V/H15Q/R76G/D77N/Q82R/V89D, I13V/H15Q/T47A/R76G/V89D, I13V/H15Q/T47A/Q82R/V89D, I13V/H15Q/N24D/Q82R/V89D, I13V/H15Q/I36V/T47A/S67L/V89D, H15Q/T47A/K65R/S67L/Q82R/V89D, H15Q/L33P/T47A/S67L/P71S/V89D, I13V/H15Q/Q72H/R76G/I86T, H15Q/T47A/S67L/Q82R/V89D, F2L/H15Q/D46E/T47A/Q72H/R76G/Q82R/V89D, I13V/H15Q/L33F/T47A/Q82R/V89D, I13V/H15Q/T47A/E58G/S67L/Q82R/V89D, H15Q/N24S/T47A/Q72H/R76G/V89D, I13V/H15Q/E44V/T47A/Q82R/V89D, H15Q/N18D/T47A/Q72H/V73A/R76G/I86T/V89D, I13V/H15Q/T37A/E44D/S48C/S67L/Q82R/V89D, H15Q/L33H/S67L/R76G/Q82R/V89D, I13V/H15Q/T47A/Q72H/R76G/I86T, H15Q/S39I/E44D/Q72H/V75G/R76G/Q82R/V89D, H15Q/T47A/S67L/R76G/Q82R/V89D, or I13V/H15Q/T47A/S67L/Q72H/R76G/Q82R/V89D, with reference to numbering set forth in SEQ ID NO:31 and 1263. In some embodiments, the variant PD-L2 contains the modification(s) H15Q/T47A/K65R/S67L/Q82R/V89D.

In some of any of the provided embodiments, the IRBM contains the sequence of amino acids set forth in any of SEQ ID NOs: 1204-1280 or a specific binding fragment thereof. In some of any of the provided embodiments, the IRBM contains the sequence of amino acids set forth in any of SEQ ID NOs: 1283-1331, 1333-1407, 1309-1432.

In some of any of the provided embodiments, the IRBM contains at least one IgSF domain of a binding partner of TIGIT. In some embodiments, the binding partner of TIGIT is CD155 or CD122 or is a variant of CD155 or CD122 that binds to PD-1. In some embodiments, the binding partner is a variant of CD155 or CD112 and the variant exhibits increased binding activity, optionally binding affinity, to TIGIT compared to the binding of unmodified or wild-type CD155 or CD112, respectively, to TIGIT. In some embodiments, the binding activity, optionally binding affinity, to TIGIT is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold. In some of any of the provided embodiments, the IRBM comprises (i) the sequence of amino acids set forth in SEQ ID NO: 47, 310 or 353, (ii) a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 47, 310 or 353; or (iii) a specific binding fragment of (i) or (ii). In some of any of the provided embodiments, the IRBM comprises (i) the sequence of amino acids set forth in SEQ ID NO: 48, 666 or 761, (ii) a sequence of amino acids that has at least 85%, 86%, 87%, 88%%, 89%, 90%, 91%, 92%, 93%, 94%, 95%, 96%, 97%, 98%, or 99% sequence identity to SEQ ID NO: 48, 666 or 761; or (iii) a specific binding fragment of (i) or (ii). In some of any such embodiments, the IRBM is a variant CD155 and the one or more amino acid modification can be any described herein, such as set forth in Section I.A.2.a. In some embodiments, the IRBM is a variant CD155 and the one or more amino acid modifications include any set forth in Table 4. In some of any such embodiments, the IRBM is a variant CD112 and the one or more amino acid modification can be any described herein, such as set forth in Section I.A.2.b. In some embodiments, the one or more amino acid modifications include any set forth in Table 5.

In some of any of the provided embodiments, the variant CD155 comprises one or more amino acid modifications selected from P18F, P18S, S67A, L104M, L104Q, G111D or G111R. In some embodiments, the variant CD155 polypeptide comprises the amino acid modification(s) P18F/T26M/L44V/Q62K/L79P/F91S/L104M/G111D, P18S/T45S/T61K/S65W/S67A/F91S/G111R, P18S/L79P/L104M/T107M, P18S/S65W/S67A/M90V/V95A/L104Q/G111R, P18S/S65W/S67A/L104Q/G111R.

In some of any of the provided embodiments, the IRBM comprises the sequence of amino acids set forth in any of SEQ ID NOs: 312-331, 375-471, 1551-1575, 1577-1622. In some of any of the provided embodiments, the IRBM comprises the sequence of amino acids set forth in any of SEQ ID NOs: 332-352, 354-374, 472-665, 1505-1550, 1575, 1576, 1623-1714.

In some of any of the provided embodiments, the ARBM or IRBM is a specific binding fragment of any of the above IgSF domain and has a length of at least 50, 60, 70, 80, 90, 100, 110 or more amino acids.

In some of any of the provided embodiments, the ARBM or IRBM is a variant of any of the above IgSF domains and the variant contains one or more amino acid modifications at one or more positions in an IgSF domain of an unmodified or wild-type IgSF domain, such as an IgSF domain of a binding partner of an activating receptor, a binding partner of a ligand of an activating receptor or a binding partner of an inhibitory receptor. In some embodiments, the one or more amino acid modification is an amino acid substitution, insertion or deletion. In some embodiments, the variant contains up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions.

In some of any of the provided embodiments, the ARBM contains an IgV domain or a specific binding fragment thereof. In some embodiments, the at least one ARBM in a provided immunomodulatory protein contains only one ARBM.

In some of any such embodiments, the IRBM contains at least one IgSF domain that is an IgV domain or a specific binding fragment thereof. In some embodiments, the at least one IRBM in a provided immunomodulatory protein contains only one IRBM. In some embodiments, the at least one IRBM in a provided immunomodulatory protein contains 2, 3, 4, 5 or more IRBMs, optionally wherein each IRBM is the same. In some embodiments, each IRBM of a provided immunomodulatory protein is linked directly or indirectly via a linker, optionally wherein the linker is a peptide linker.

In some of any of the provided embodiments, the at least one IRBM and the at least one ARBM are linked direct or indirectly via a linker. In some instances, the embodiments is a peptide linker.

In some of any such embodiments, the peptide linker is selected from GSGGS (SEQ ID NO: 2523), GGGGS (G4S; SEQ ID NO: 1942), GSGGGGS (SEQ ID NO: 1941), GGGGSGGGGS (2×GGGGS; SEQ ID NO: 240), GGGGSGGGGSGGGGS (3×GGGGS; SEQ ID NO: 239), GGGGSSA (SEQ ID NO: 2524) or combinations thereof.

In some embodiments, the at least one IRBM is amino-terminal to the at least one ARBM in the polypeptide. In some embodiments, the at least one IRBM is carboxy-terminal to the at least one ARBM in the polypeptide. In some embodiments, the immunomodulatory protein contains at least two IRBM. In some of any such embodiments, at least one IRBM is amino-terminal to the at least one ARBM in the polypeptide and at least one IRBM is carboxy-terminal to the at least one ARBM in the polypeptide.

In some of any of the provided embodiments, the immunomodulatory protein is a multi-domain protein in which the ARBM contains at least one IgSF domain of CTLA-4 or a variant thereof, e.g affinity-modified domain thereof, and the IRBM contains at least one IgSF domain of PD-L1 or a variant thereof, e.g affinity-modified domain thereof.

In some of any of the provided embodiments, the immunomodulatory protein a multi-domain protein in which the ARBM contains at least one IgSF domain of ICOS-L or a variant thereof, e.g affinity-modified domain thereof, and the IRBM contains at least one IgSF domain of PD-L1 or a variant thereof, e.g affinity-modified domain thereof.

In some of any of the provided embodiments, the immunomodulatory protein a multi-domain protein in which the ARBM contains at least one IgSF domain of ICOS-L or a variant thereof, e.g affinity-modified domain thereof, and the IRBM contains at least one IgSF domain of PD-L2 or a variant thereof, e.g affinity-modified domain thereof.

In some of any of the provided embodiments, the immunomodulatory protein is a multi-domain protein in which the ARBM contains at least one IgSF domain of CD58 or a variant thereof, e.g affinity-modified domain thereof, and the IRBM contains at least one IgSF domain of PD-L1 or a variant thereof, e.g affinity-modified domain thereof.

In some of any of the provided embodiments, the immunomodulatory protein is a multi-domain protein in which the ARBM contains at least one IgSF domain of CTLA-4 or a variant thereof, e.g affinity-modified domain thereof, and the IRBM contains at least one IgSF domain of CD155 or a variant thereof, e.g affinity-modified domain thereof.

In some of any of the provided embodiments, the immunomodulatory protein is a multi-domain protein in which the ARBM contains at least one IgSF domain of CD58 or a variant thereof, e.g affinity-modified domain thereof, and the IRBM contains at least one IgSF domain of CD155 or a variant thereof, e.g affinity-modified domain thereof.

In some of any of the provided embodiments, the immunomodulatory protein is a multi-domain protein in which the ARBM contain at least one IgSF domain of ICOSL or a variant thereof, e.g affinity-modified domain thereof, and the IRBM contains at least one IgSF domain of CD155 or a variant thereof, e.g affinity-modified domain thereof.

In some of any of the provided embodiments, the immunomodulatory protein is an immunomodulatory protein set forth in any of Tables E2, E3A, E3B, E4 or E5.

In some embodiments, the immunomodulatory protein is a monomer and/or contains a single polypeptide chain. In some embodiments, the immunomodulatory protein comprises the sequence of amino acids set forth in any of SEQ ID NOS: 2563, 2567, 2569, 2571, 2573, 2575, 2577, 2579, 2581, 2583, 2585, 2587, 2589, 2591, 2593, 2595, 2597, 2599, 2601, 2603, 2605, 2607, 2609, 2612, 2614, 2619, 2621, 2623, 2625, 2627, 2629, 2631, 2633, 2635, 2637, 2639, 2641, 2643, 2645, 2647, 2649, 2651, 2653, 3496, 3497, 3498, 3499, 3500, 3501, 3502, 3535, 3656, 3658, or a sequence that exhibits at least 85% 86%, 87%, 88%, 89%, 90%, 91%, 92%, 93%, 94%, 95%, 96%, 97%, 98%, 99% or more sequence identity to any of SEQ ID Nos: 2563, 2567, 2569, 2571, 2573, 2575, 2577, 2579, 2581, 2583, 2585, 2587, 2589, 2591, 2593, 2595, 2597, 2599, 2601, 2603, 2605, 2607, 2609, 2612, 2614, 2619, 2621, 2623, 2625, 2627, 2629, 2631, 2633, 2635, 2637, 2639, 2641, 2643, 2645, 2647, 2649, 2651, 2653, 3496, 3497, 3498, 3499, 3500, 3501, 3502, 3535, 3656, 3658 and retains the same or similar activity.

In some of any such embodiments, the immunomodulatory protein contains the sequence of amino acids set forth in any of SEQ ID NOS:2541, 2543, 2563, 2567, 2569, 2579, 2583, 2585, 2587, 2589, 2591, 2595, 2597, 2599, 2601, 2603, 2605, 2607, 2609, 2631, 2643, 2651, or a sequence that exhibits at least 85% 86%, 87%, 88%, 89%, 90%, 91%, 92%, 93%, 94%, 95%, 96%, 97%, 98%, 99% or more sequence identity thereto and retains the same or similar activity.

In some of any of the provided embodiments, the immunomodulatory protein contains the sequence of amino acids set forth in any of SEQ ID NOS: 2583, 2587, 2603, 2651, or a sequence that exhibits at least 85% 86%, 87%, 88%, 89%, 90%, 91%, 92%, 93%, 94%, 95%, 96%, 97%, 98%, 99% or more sequence identity thereto and retains the same or similar activity.

In some of any of the provided embodiments, the immunomodulatory protein contains the sequence of amino acids set forth in any of SEQ ID NOS: 2541, 2533, 2651, 3522, 3523, 3664, 3666, 3668, 3674, 3766 or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 3522, 3523, 3664, 3666, 3668, 3674, 3766 and retains the same or similar activity. In some embodiments, the immunomodulatory protein contains the sequence of amino acids set forth in SEQ ID NO:3522 or 3666 or a sequence that exhibits at least 85% 86%, 87%, 88%, 89%, 90%, 91%, 92%, 93%, 94%, 95%, 96%, 97%, 98%, 99% or more sequence identity to SEQ ID NO: 3522 or 3566. In some embodiments, the immunomodulatory protein contains the sequence of amino acids set forth in SEQ ID NO:3523 or 3668 or a sequence that exhibits at least 85% 86%, 87%, 88%, 89%, 90%, 91%, 92%, 93%, 94%, 95%, 96%, 97%, 98%, 99% or more sequence identity to SEQ ID NO: 3523 or 3568. In some embodiments the immunomodulatory proteins binds CD80 or CD86 and binds PD-1.

In some of any of the provided embodiments, the immunomodulatory protein contains the sequence of amino acids set forth in any of SEQ ID NOS: 2583, 2587, 2603, 3678 or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 2583, 2587, 2603, 3678 and retains the same or similar activity. In some embodiments the immunomodulatory proteins binds CD28 and binds PD-1.

In some of any of the provided embodiments, the immunomodulatory protein contains the sequence of amino acids set forth in any of SEQ ID NOS: 3680, 3682, 3684, 3686, 3688 or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 3680, 3682, 3684, 3686, 3688 and retains the same or similar activity. In some embodiments the immunomodulatory proteins binds CD2 and binds PD-1.

In some of any of the provided embodiments, the immunomodulatory protein contains the sequence of amino acids set forth in any of SEQ ID NOS: 3652, 3654, or 3664 or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 3652, 3654, or 3664 and retains the same or similar activity. In some embodiments the immunomodulatory proteins binds CD80 or CD86 and binds TIGIT.

In some of any of the provided embodiments, the immunomodulatory protein contains the sequence of amino acids set forth in any of SEQ ID NOS: 3656 or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 3656 and retains the same or similar activity. In some embodiments the immunomodulatory proteins binds CD28 and binds TIGIT.

In some of any of the provided embodiments, the immunomodulatory protein contains the sequence of amino acids set forth in any of SEQ ID NOS: 3660 or 3662 or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 3660 or 3662 and retains the same or similar activity. In some embodiments the immunomodulatory proteins binds CD2 and binds TIGIT.

In some of any of the provided embodiments, the ARBM and IRBM are linked by a linker and the linker is or includes a multimerization domain. In some embodiments, the multimerization domain promotes dimerization, trimerization, tetramerization, or pentamerization. In some embodiments, the immunomodulatory protein is a dimer, trimer, tetramer, or a pentamer.

In some embodiments, the immunomodulatory protein is a dimer, optionally wherein each polypeptide of the dimer is linked to a multimerization domain. In some aspects, the multimerization domain is an Fc domain. In some of any such embodiments, the Fc domain is an IgG, optionally an IgG1, IgG2 or IgG4, Fc domain. In some cases, the Fc domain is an IgG1 Fc domain. In some embodiments, the Fc domain is a human Fc domain.

In some of any such embodiments, the Fc domain exhibits reduced binding affinity to an Fc receptor and/or reduced effector function, optionally as compared to a native IgG1 Fc domain. In some aspects, the Fc domain contains one or more amino acid substitution that reduces binding to an Fc receptor and or effector function, optionally wherein the one or more amino acid substitutions are in a native IgG1 Fc domain. In some examples, the one or more amino acid substitutions in the Fc domain are selected from E233P, L234A, L234V, L235A, L235E, G236del, G237A, S267K, N297G, V302C and K447del, each by EU numbering. In some embodiments, the Fc contains the amino acid substitutions L234A, L235E an G237A by EU numbering. In some embodiments, the Fc contains the amino acid substitutions R292C, N297G and V302C by EU numbering.

In some embodiments, the immunomodulatory protein contains a first polypeptide chain comprising the at least one ARBM, the at least one IRBM and a first multimerization domain, optionally wherein the first multimerization domain is a first Fc domain, and a second polypeptide chain comprising the at least one ARBM, the at least one IRBM and a second multimerization domain, optionally wherein the second multimerization domain is a second Fc domain, wherein the first and second multimerization domains. In some embodiments the first and second Fc domains are able to interact to form a dimer comprising the first and second polypeptides. In some embodiments, the at least one IRBM is amino-terminal to the at least one ARBM in the first and/or second polypeptide.

In some embodiments, the first and second multimerization domain, optionally the first and second Fc domain, are the same. In some embodiments, the immunomodulatory protein is a homodimer.

In some embodiments, the Fc domain contains the sequence of amino acids set forth in any of SEQ ID NOs:187 or 3538 or a sequence of amino acids that exhibits at least 85%, 90%, 95%, 96%, 97%, 98%, or 99% sequence identity to any of SEQ ID NOs: 187 or 3538. In some embodiments, the Fc domain contains the sequence of amino acids set forth in any of SEQ ID NOs:1155, 1157, 1158, 1159, 1938, 1939 or 1940 or a sequence of amino acids that exhibits at least 85%, 90%, 95%, 96%, 97%, 98%, or 99% sequence identity to any of SEQ ID NOs: 1155, 1157, 1158, 1159, 1938, 1939 or 1940. In some embodiments, the Fc domain contains the sequence of amino acids set forth in any of SEQ ID NOs:1158, 1715 or 3579 or a sequence of amino acids that exhibits at least 85%, 90%, 95%, 96%, 97%, 98%, or 99% sequence identity to any of SEQ ID NOs: 1158, 1715 or 3579.

In some of any such embodiments, the immunomodulatory protein contains the sequence of amino acids set forth in any of SEQ ID NOS: 2529, 2530, 2531, 2533, 2535, 2537, 2539, 2541, 2543, 3516, 3517, 3518, 3519, 3520, 3521, 3522, 3523, 3524, 3652, 3654, 3660, 3662, 3664, 3666, 3668, 3670, 3672, 3674, 3676, 3680, or 3682 ora sequence that exhibits at least 85% 86%, 87%, 88%, 89%, 90%, 91%, 92%, 93%, 94%, 95%, 96%, 97%, 98%, 99% or more sequence identity to any of SEQ ID NOS: 2529, 2530, 2531, 2533, 2535, 2537, 2539, 2541, 2543, 3516, 3517, 3518, 3519, 3520, 3521, 3522, 3523, 3524, 3652, 3654, 3660, 3662, 3664, 3666, 3668, 3670, 3672, 3674, 3676, 3680, or 3682 and retains the same activity.

In some embodiments, the immunomodulatory includes a first polypeptide chain containing (i) one of the at least one ARBM or the at least one IRBM and (ii) a first multimerization domain, optionally wherein the first multimerization domain is a first Fc domain and a second polypeptide chain comprising (i) the other of the at least one ARBM or the at least one IRBM and (b) a second multimerization domain, optionally wherein the second multimerization domain is a second Fc domain, wherein the first and second multimerization domains, optionally the first and second Fc domains, interact to form a dimer comprising the first and second polypeptides. In some embodiments, the first and second multimerization domains, optionally the first and second Fc domains, are different. In some of any of the provided embodiments, the immunomodulatory protein is a heterodimer.

In some embodiments, each polypeptide of the dimer is linked to an Fc domain and wherein the Fc domains contain a knob-into-hole modification or contain a charge mutation to reduce or prevent self-association due to charge repulsion.

In some embodiments, the Fc domain contains a knob-into-hole modification wherein one of the Fc domains contains a knob modification comprising the amino acid substitution T366W and the other one of the Fc domain contains a hole modification selected from T366S, L368A and/or Y407V, each by EU numbering. In some examples, the Fc domain containing the knob modification further contains the amino acid substitution S354C and the Fc domain comprising the hole modification further contains the amino acid substitution Y349C, each by EU numbering. In some embodiments, one of the Fc domains includes the sequence set forth in any of SEQ ID NO:1153 or 2558 or a sequence of amino acids that exhibits at least 85%, 90%, 95%, 96%, 97%, 98%, or 99% sequence identity to any of SEQ ID NO: 1153 or 2558 and contains the knob-into-hole modifications, optionally amino acid substitutions T366W and/or S354C, and the other Fc domain includes the sequence set forth in SEQ ID NO: 1154 or 2559 or a sequence of amino acids that exhibits at least 85%, 90%, 95%, 96%, 97%, 98%, or 99% sequence identity to any of SEQ ID NOs: 1154 or 2559 and contains the knob-into-hole modifications, optionally Y349C, T366S, L368A and/or Y407V.

In some embodiments, the Fc domain includes a charge mutation wherein one of the Fc domains contains the amino acid substitution E356K, E357K and/or D399K and the other of the Fc domains contains the amino acid substitution K370D, K392D and/or K409D. In some cases, one of the Fc domains contains the sequence set forth in SEQ ID NO:2544 or a sequence of amino acids that exhibits at least 85%, 90%, 95%, 96%, 97%, 98%, or 99% sequence identity to SEQ ID NO: 2544 and includes the charge mutation, optionally the amino acid substitution E356K, E357K and/or D399K, and the other of the Fc domains includes the sequence set forth in SEQ ID NO:2544 or a sequence of amino acids that exhibits at least 85%, 90%, 95%, 96%, 97%, 98%, or 99% sequence identity to SEQ ID NO: 2544 and contains the charge mutation, optionally the amino acid substitution K370D, K392D and/or K409D.

In some of any such embodiments, the immunomodulatory protein contains a first and second polypeptide comprising the sequence of amino acids set forth in SEQ ID NOs: 2547 and 2549, SEQ ID Nos: 2547 and 2551, SEQ ID Nos: 2553 and 2549, SEQ ID Nos: 2553 and 2551, SEQ ID Nos: 2547 and 2555, SEQ ID Nos: 2547 and 2557, SEQ ID Nos: 2553 and 2555 and SEQ ID Nos: 2553 and 2557, SEQ ID Nos: 2526 and 2528, SEQ ID Nos: 2526 and 2561, SEQ ID Nos: 3513 and 3514 or SEQ ID Nos: 3515 and 3514, or a sequence that exhibits at least 85% 86%, 87%, 88%, 89%, 90%, 91%, 92%, 93%, 94%, 95%, 96%, 97%, 98%, 99% or more sequence identity to each of SEQ ID NOs: 2547 and 2549, SEQ ID Nos: 2547 and 2551, SEQ ID Nos: 2553 and 2549, SEQ ID Nos: 2553 and 2551, SEQ ID Nos: 2547 and 2555, SEQ ID Nos: 2547 and 2557, SEQ ID Nos: 2553 and 2555 and SEQ ID Nos: 2553 and 2557, SEQ ID Nos: 2526 and 2528, SEQ ID Nos: 2526 and 2561, SEQ ID Nos: 3513 and 3514 or SEQ ID Nos: 3515 and 3514 and retains the same activity.

In some embodiments, the ARBM and IRBM are linked by a multimerization domain that promotes dimerization, trimerization, tetramerization, or pentamerization. In some embodiments, the multimerization domain is a portion of a cartilage oligomeric protein (COMP), such as set forth in SEQ ID NO:3503. In some embodiments, the multimerization domain is a vasodilatory-stimulated phosphoprotein (VASP) tetramerization domain, such as set forth in SEQ ID NO:3504. In some embodiments, the multimerization domain is a ZymoZipper (ZZ) domain, such as set forth in SEQ ID NO:3505.

In some of any of the provided embodiments, the immunomodulatory protein contains the sequence of amino acids set forth in any of SEQ ID NOS: 3507, 3509 or 3678, or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 3507, 3509 or 3678 and retains the same activity.

In some embodiments, the immunomodulatory protein contains the sequence of amino acids set forth in any of SEQ ID NOS:2541, 2533, or a sequence that exhibits at least 85% 86%, 87%, 88%, 89%, 90%, 91%, 92%, 93%, 94%, 95%, 96%, 97%, 98%, 99% or more sequence identity to SEQ ID NOS:2541 or 2533 and retains the same activity.

Provided herein is an immunomodulatory protein that contains the sequence of amino acids set forth in any of SEQ ID NOS: 3506, 3508, 3510 or 3511, or a sequence that exhibits at least 85% 86%, 87%, 88%, 89%, 90%, 91%, 92%, 93%, 94%, 95%, 96%, 97%, 98%, 99% or more sequence identity to any of SEQ ID NOS: 3506, 3508, 3510 or 3511 and retains the same activity.

In some of any of the provided embodiments, the immunomodulatory protein further contains a detectable moiety, optionally wherein the detectable moiety is a peptide capable of detection, optionally wherein the peptide capable of detection is a flag tag or a his tag.

In some of any of the provided embodiments, the IRBM has a dissociation constant for binding the inhibitory receptor of from 0.001 nM to 1000 nM, from or from about 0.01 nM to about 500 nM, from or from about 0.01 nM to about 400 nM, from or from about 0.01 nM to about 100 nM, from or from about 0.01 nM to about 50 nM, from or from about 0.01 nM to about 10 nM, from or from about 0.01 nM to about 1 nM, from or from about 0.01 nM to about 0.1 nM, is from or from about 0.1 nM to about 500 nM, from or from about 0.1 nM to about 400 nM, from or from about 0.1 nM to about 100 nM, from or from about 0.1 nM to about 50 nM, from or from about 0.1 nM to about 10 nM, from or from about 0.1 nM to about 1 nM, from or from about 0.5 nM to about 200 nM, from or from about 1 nM to about 500 nM, from or from about 1 nM to about 100 nM, from or from about 1 nM to about 50 nM, from or from about 1 nM to about 10 nM, from or from about 2 nM to about 50 nM, from or from about 10 nM to about 500 nM, from or from about 10 nM to about 100 nM, from or from about 10 nM to about 50 nM, from or from about 50 nM to about 500 nM, from or from about 50 nM to about 100 nM or from or from about 100 nM to about 500 nM.

In some of any of the provided embodiments, the ARBM has a dissociation constant for binding the activating receptor or a ligand of the activating receptor of from or from about 0.001 nM to 1000 nM, from or from about 0.01 nM to about 500 nM, from or from about 0.01 nM to about 400 nM, from or from about 0.01 nM to about 100 nM, from or from about 0.01 nM to about 50 nM, from or from about 0.01 nM to about 10 nM, from or from about 0.01 nM to about 1 nM, from or from about 0.01 nM to about 0.1 nM, is from or from about 0.1 nM to about 500 nM, from or from about 0.1 nM to about 400 nM, from or from about 0.1 nM to about 100 nM, from or from about 0.1 nM to about 50 nM, from or from about 0.1 nM to about 10 nM, from or from about 0.1 nM to about 1 nM, from or from about 0.5 nM to about 200 nM, from or from about 1 nM to about 500 nM, from or from about 1 nM to about 100 nM, from or from about 1 nM to about 50 nM, from or from about 1 nM to about 10 nM, from or from about 2 nM to about 50 nM, from or from about 10 nM to about 500 nM, from or from about 10 nM to about 100 nM, from or from about 10 nM to about 50 nM, from or from about 50 nM to about 500 nM, from or from about 50 nM to about 100 nM or from or from about 100 nM to about 500 nM.

In some of any of the provided embodiments, the immunomodulatory protein attenuates, decreases or reduces an immune response. In some embodiments, the immune response is a T cell response. In some embodiments, a reduced, decreased or attenuated T cell response includes one or more of cell cycle inhibition, reduced cell survival, reduced cell proliferation, reduced cytokine production (e.g. IFN-gamma or IL-2), or reduced T-cell cytotoxicity. In some embodiments, the reduced activity is observed in vitro in a primary T cell activation assays, such as in a Jurkat reporter assay, SEB assay or mixed lymphocyte reaction (MLR) assay. In some embodiments, the activity is reduced by at least 10%, 20%, 30%, 40%, 50%, 60%, 70%, 80%, 90%, or 100% compared to the activity in the same assay in the absence of the immunomodulatory protein. In some embodiments, the activity is reduced by at least 10%, 20%, 30%, 40%, 50%, 60%, 70%, 80%, 90%, or 100% compared to the activity in the same assay presence of a control in which the control is a protein that is known or suspected not to modulate T cell activity, e.g. an Fc only control. In some embodiments, the activity is reduced to a level that is greater than the reduction observed by a reference immunomodulatory protein containing only the ARBM or containing only the IRBM, such as is reduced by greater than or greater than about 1.2-fold, 1.3-fold, 1.4-fold, 1.5-fold, 2.0-fold, 3.0-fold, 4.0-fold 5.0-fold or more compared to the reference immunomodulatory protein.

In some of any such embodiments, upon contact of the immunomodulatory protein with the immune cell, the immunomodulatory protein proximalizes association of the inhibitory receptor and activating receptor by the immune cell. In some cases, upon contact of the immunomodulatory protein with the immune cell, the immunomodulatory protein recruits a cytoplasmic protein tyrosine phosphatase to the intracellular region of the inhibitory receptor, optionally wherein the protein tyrosine phosphatase is a SHP-1 or SHP-2. In some of any such embodiments, the immune cell is a T cell. In some embodiments, contact of the immunomodulatory protein and immune cell is in vitro or in vivo.

In some of any of the provided embodiments, binding of the IRBM of the immunomodulatory protein to the inhibitory receptor on the immune cell blocks or antagonizes binding between the inhibitory receptor and its cognate ligand. In some such embodiments, the cognate ligand is expressed on an antigen presenting cell. In some such embodiments, the immune cell is a T cell.

In some of any of the provided embodiments, binding of the ARBM of the immunomodulatory protein to the activating receptor on the immune cell blocks or antagonizes binding between the activating receptor and its cognate ligand. In some such embodiments, the cognate ligand is expressed on an antigen presenting cell. In some such embodiments, the immune cell is a T cell.

In some of any of the provided embodiments, binding of the ARBM of the immunomodulatory protein to the ligand of an activating receptor, in which said activating receptor is expressed on the immune cell, blocks or antagonizes binding between the activating receptor and the ligand. In some such embodiments, the ligand is expressed on an antigen presenting cell. In some such embodiments, the immune cell is a T cell.

In some of any of the provided embodiments, the immunomodulatory protein increases an immune response. In some embodiments, the immune response is a T cell response. In some embodiments, an increased T cell response includes one or more of increased cell activation, increased cell differentiation, increased or greater cell survival, increased cell proliferation, increased cytokine production (e.g. IFN-gamma or IL-2), or increased T-cell cytotoxicity. In some embodiments, the increased activity is observed in vitro in a primary T cell activation assays, such as in a Jurkat reporter assay, SEB assay or mixed lymphocyte reaction (MLR) assay. In some embodiments, the activity is increased by at least 10%, 20%, 30%, 40%, 50%, 60%, 70%, 80%, 90%, or 100% compared to the activity in the same assay in the absence of the immunomodulatory protein. In some embodiments, the activity is increased by at least 10%, 20%, 30%, 40%, 50%, 60%, 70%, 80%, 90%, or 100% compared to the activity in the same assay in the presence of a control in which the control is a protein that is known or suspected not to modulate T cell activity, e.g. an Fc only control. In some embodiments, the activity is increased to a level that is greater than the reduction observed by a reference immunomodulatory protein containing only the ARBM or containing only the IRBM, such as is increased by greater than or greater than about 1.2-fold, 1.3-fold, 1.4-fold, 1.5-fold, 2.0-fold, 3.0-fold, 4.0-fold 5.0-fold or more compared to the reference immunomodulatory protein.

Provided are nucleic acid molecules encoding any of the provided immunomodulatory proteins. In some cases, the nucleic acid molecule is a synthetic nucleic acid. In some cases, the nucleic acid molecule is a cDNA. In some of any of the provided embodiments, the nucleic acid includes any having a DNA SEQ ID NO set forth in any of Tables E2, E3A, E3B, E4 or E5.

Provided are vectors containing any of the provided nucleic acid molecules. In some cases, the vector is an expression vector. In some embodiments, the vector is a mammalian expression vector or a viral vector.

Provided are cells containing any of the provided nucleic acid molecules. Provided are cells containing any of the provided vectors. In some cases, the cell is a mammalian cell. In some embodiments, the cell is a human cell.

Provided are methods of producing an immunomodulatory protein including introducing any of the provided nucleic acid molecules or vectors into a host cell under conditions to express the protein in the cell. In some cases, the method further includes isolating or purifying the immunomodulatory protein from the cell.

Provided are methods of engineering a cell expressing an immunomodulatory protein including introducing a nucleic acid molecule encoding a polypeptide or polypeptides of any of the provided immunomodulatory proteins into a host cell under conditions in which the polypeptide is expressed in the cell.

Provided are engineered cells expressing any of the provided immunomodulatory proteins, nucleic acid molecules, or vectors. In some cases, the immunomodulatory protein is capable of being secreted from the engineered cell.

In some embodiments, the immunomodulatory protein does not contain a cytoplasmic signaling domain or transmembrane domain and/or is not capable of mediating or modulating an intracellular signal when secreted from a cell. In some embodiments, the cell is an immune cell. In some embodiments, the immune cell is a lymphocyte. In some embodiments, the lymphocyte is a T cell. In some examples, the T cell is a CD4+ and/or CD8+ T cell. In some examples, the T cell is a regulatory T cell (Treg). In some embodiments, the engineered cell is a primary cell. In some embodiments, the cell is a mammalian cell. In some embodiments, the cell is a human cell. In some embodiments, the engineered cell further contains a chimeric antigen receptor (CAR). In some embodiments, the engineered cell further contains an engineered T-cell receptor (TCR).

Provided are infectious agents containing a nucleic acid molecule encoding any of the provided immunomodulatory proteins. In some embodiments, the infectious agent is a bacterium or a virus.

Also provided are pharmaceutical compositions containing any of the provided immunomodulatory proteins. Also provided are pharmaceutical compositions containing any of the provided engineered cells. Also provided are pharmaceutical compositions containing any of the provided infectious agents. In some embodiments, the pharmaceutical composition further contains a pharmaceutically acceptable excipient. In some embodiments, the pharmaceutical composition is sterile.

Provided are articles of manufacture containing any of the provided pharmaceutical compositions in a vial or container. In some cases, the vial or container is sealed.

Provided are kits containing any of the provided pharmaceutical compositions and instructions for use. Also provided are kits containing any of the provided articles of manufacture and instructions for use.

Provided are methods of modulating an immune response in a subject including administering any of the provided immunomodulatory proteins to the subject. Provided are methods of modulating an immune response in a subject including administering any of the provided pharmaceutical compositions to the subject. Also provided are methods of modulating an immune response in a subject, including administering any of the provided engineered cells. In some cases, the engineered cells are autologous to the subject. In some embodiments, the engineered cells are allogenic to the subject.

In some of any of the provided embodiments, modulating the immune response treats a disease or condition in the subject. In some cases, the immune response is decreased. Also provided are methods of treating a disease or condition in a subject including administering any of the provided immunomodulatory proteins to the subject. Also provided are methods of treating a disease or condition in a subject including administering any of the provided pharmaceutical compositions to the subject. In some embodiments, the disease or condition is an inflammatory or autoimmune disease or condition, or is a disease or condition associated with an overactive immune response. In some embodiments, the disease or condition is an Antineutrophil cytoplasmic antibodies (ANCA)-associated vasculitis, a vasculitis, an autoimmune skin disease, transplantation, a Rheumatic disease, a thyroiditis, an inflammatory gastrointestinal disease, an inflammatory eye disease, an inflammatory neurological disease, an inflammatory pulmonary disease, an inflammatory endocrine disease, an autoimmune hematological disease, an autoimmune demyelinating disease, or an autoimmune disease involving a systemic autoimmune disorder.

In some examples, the disease or condition is selected from among inflammatory bowel disease, transplant, Crohn's disease, ulcerative colitis, asthma, autoimmune asthma, rheumatoid arthritis, psoriasis, lupus erythematosus, celiac disease, type I diabetes mellitus, Guillain-Barre syndrome, Chronic inflammatory demyelinating polyneuropathy, Graves' disease, Hashimoto's thyroiditis, DeQuervains thyroiditis, myasthenia gravis, Vasculitis, autoimmune hemolytic anemia, autoimmune atrophic gastritis of pernicious anemia, autoimmune encephalomyelitis, autoimmune orchitis, Goodpasture's disease, autoimmune thrombocytopenia, sympathetic opthalmia, primary biliary cirrhosis, chronic aggressive hepatitis, membranous glomerulopathy, primary idiopathic myxedema, scleroderma, chronic hepatitis, Addison's disease, hypogonadism, pernicious anemia, vitiligo, alopecia areata, autoimmune enteropathy syndrome, idiopathic thrombocytic purpura, acquired splenic atrophy, idiopathic diabetes insipidus, infertility due to antispermatazoan antibodies, sensoneural hearing loss, Sjogren's syndrome, polymyositis, multiple sclerosis, transverse myelitis, ataxic sclerosis, *Pemphigus*, progressive systemic sclerosis, dermatomyositis, polyarteritis nodosa, hemolytic anemia, glomerular nephritis, and idiopathic facial paralysis. In some cases, the disease or condition is a vasculitis that is a giant cell arteritis (GCA).

In some embodiments, the immunomodulatory protein increases an immune response in the subject. In some embodiments, the disease or condition is a cancer.

DETAILED DESCRIPTION

Figure 1A:
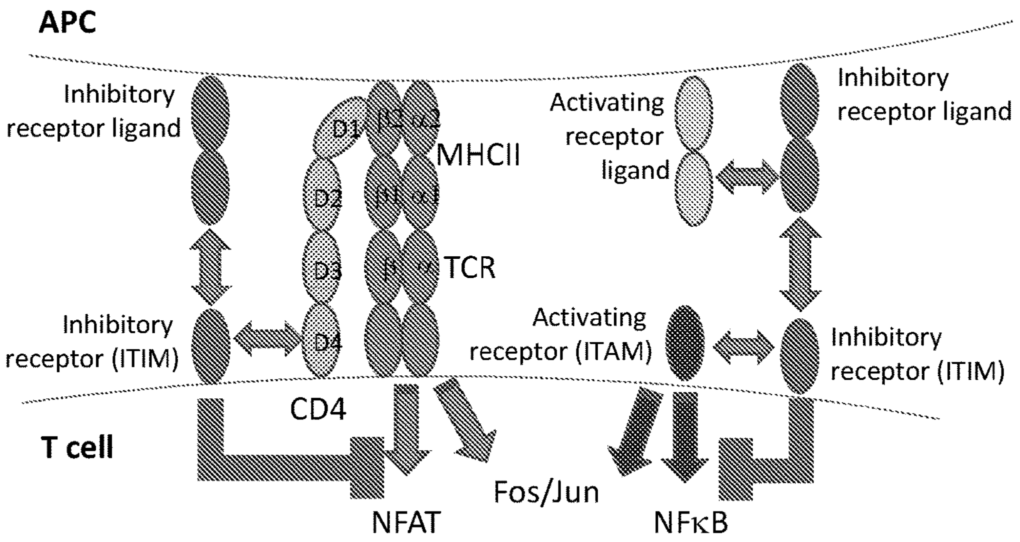
FIG. 1A depicts the proximalization of ITIM bearing inhibitory receptors with activating receptors on T cells or the inhibitory ligand and activating ligand of such receptors on APC to make possible attenuation of T cell activation and/or tolerance induction.

Provided herein are multi-domain immunomodulatory proteins that are capable of binding to two or more protein cell surface molecules to modulate, e.g. suppress, immunological immune responses. In some embodiments, the cell surface molecules are cell surface proteins expressed by immune cells, such as T lymphocytes, that engage with one or more other immune receptor or ligand, e.g. on antigen-presenting cells, to induce inhibitory or activating signals. For example, the interaction of certain receptors on lymphocytes with their cognate cell surface ligands to form an immunological synapse (IS) between antigen-presenting cells (APCs) or target cells and lymphocytes can provide costimulatory or inhibitory signals that can regulate the immune system. In some aspects, the multi-domain immunomodulatory proteins provided herein can alter the interaction of cell surface protein ligands with their receptors and/or alter the cell signal(s) induced in a cell to thereby modulate immune cells, such as T cell, activity. In some embodiments, the immunomodulatory proteins provided herein can be used for the treatment of diseases or conditions that are associated with a dysregulated immune response, such as autoimmune symptoms or an autoimmune disease.

In general, antigen specific T-cell activation generally requires two distinct signals. The first signal is provided by the interaction of the T-cell receptor (TCR) with major histocompatibility complex (MHC) associated antigens present on antigen presenting cells (APCs). The second signal is costimulatory to TCR engagement and is necessary for T cell proliferation, differentiation and/or survival, including, in some cases, to avoid T-cell apoptosis or anergy. In some embodiments, under normal physiological conditions, the T cell-mediated immune response is initiated by antigen recognition by the T cell receptor (TCR) and is regulated by a balance of co-stimulatory activating signals and inhibitory signals (i.e., immune checkpoint proteins).

Among activating receptors on T cells are the costimulatory receptor CD28, which binds to costimulatory ligands CD80 (also called B7-1) and CD86 (also called B7-2), and promotes activation of naïve T cells in the presence of a TCR signal. T cell activation, however, can be attenuated by engagement of inhibitory receptors, such as PD-1, CTLA-4 or TIGIT. For example, CTLA-4 competes with CD28 for binding of CD80 and CD86 to induce negative regulation of T cell activation. When CTLA-4 binds CD80 and/or CD86, and prevents CD28 from binding its cognate ligands, T cells do not effectively transmit the activating signaling cascade, and T cell activation and effector function can be eliminated or attenuated. In some cases, engagement of PD-1, expressed on NK cells and T cells, by its ligands PD-L1 and PD-L2, negatively regulate immune activation to inhibit activation, including by inhibiting cytolytic activity, proliferation and/or cytokine production. Similarly, TIGIT, which also can be expressed on NK cells and T cells, can suppress or inhibit the cytolytic activity of NK cells and T cells, T cell proliferation and/or proinflammatory cytokine production via engagement by its ligands CD112 or CD155. Inhibitory receptor ligands are, in some cases, expressed on antigen presenting cells, such that the ability to negatively regulate an immune response is often dependent on cells expressing activating or inhibitory receptors being present in the same space at the same time.

The immune system relies on immune checkpoints to prevent autoimmunity (i.e., self-tolerance) and to protect tissues from excessive damage during an immune response, for example during an attack against a pathogenic infection. In some cases, however, the immune system can become dysregulated and an abnormal immune response can be mounted against a normal body part or tissue, resulting in an autoimmune disease or condition or autoimmune symptoms. In other cases an unwanted immune response can be mounted to a foreign tissue, such as a transplant, resulting in transplant rejection.

In some aspects, immunotherapy that alters immune cell activity, such as T cell activity, can treat certain diseases and conditions in which the immune response is dysregulated. In particular, inhibition or attenuation of an immune response, such as a T cell response, could be desirable to reduce or prevent unwanted autoimmune symptoms and/or transplant rejection. Therapeutic approaches that seek to modulate interactions in the IS, however, are not entirely satisfactory. In some cases, therapies to intervene and alter the immunomodulatory effects of immune cell, e.g. T cell, activation are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. For example, soluble receptors and antibodies generally bind competitively (e.g., to no more than one target species at a time) and therefore lack the ability to simultaneously bind multiple targets. And while bispecific antibodies, as well as modalities comprising dual antigen binding regions, can bind to more than one target molecule simultaneously, the three-dimensional configuration typical of these modalities often precludes them intervening in key processes occurring in the IS in a manner consistent with their temporal and spatial requirements. Additionally, pharmacokinetic differences between drugs that independently target one of these receptors can create difficulties in properly maintaining a desired blood concentration of a drug combination targeting two different targets throughout the course of treatment.

Further, in some cases, existing therapeutic drugs may only have the ability to antagonize but not agonize an immune response. For example, the inhibitory receptor PD-1 has proven to be an effective inhibitory checkpoint receptor that regulates T cell activation. Therapeutic molecules that antagonize PD-1/PD-L1 interactions have proven to be efficacious in stimulating patient immune responses towards tumors. Therapeutic molecules targeting PD-1 or its ligands, however, have not been demonstrated to do the reverse, such as to mediate an inhibitory signal intrinsically into the T cell to attenuate an immune response. Such a therapeutic molecule would be desirable for use in treating inflammatory or autoimmune diseases or conditions.

Thus, there is a need for therapeutic molecules that have the specificity and affinity of antibodies or soluble receptors but, in addition, attenuate immune responses intrinsically through an immune cell, such as a T cell. It is contemplated herein that the inability for molecules targeting inhibitory receptors, such as PD-1, to deliver negative signals into a cell is due to the inability of such molecules to proximalize signaling of an inhibitory and activating receptor in the cell. Inhibitory receptors contain an immunoreceptor tyrosine-based inhibitory motif (ITIM), which when phosphorylated upon engagement of the inhibitor receptor by a ligand, can recruit phosphotyrosine phosphatases, such as a SHP-1 or SHP-2. Recruiting phosphatases can attenuate activating signaling cascades when the ITIM bearing receptors are in close proximity to the activating receptor (see FIGS. 1A, 1B, and 2). It is believed that, in some aspects, monoclonal antibodies may not be efficacious as PD-1 agonists because simply cross-linking the inhibitory receptor does not facilitate inhibitory activity.

The provided embodiments are based on findings that strategies that physically proximalize the inhibitory and the activating receptor of the surface of the same immune cell, such as a T cell, include the uses of reagents that can bind both the inhibitory and activating receptor. In some embodiments, binding of both the inhibitory and activating receptor can keep the ITIM and ITAM signaling components in close proximity, including, in some cases for extended periods of time, and thereby favor phosphatase dependent dephosphorylation of the activating receptor signaling cascades to attenuate immune responses.

Provided are therapeutic molecules that, in some embodiments, bind both T-cell activation signaling components, such as the activating receptor or its ligand, and inhibitory receptors. In some cases, the inhibitory receptor is an ITIM containing receptor and the activating receptor is a molecule that contains an ITAM and/or that associates or interacts with an adaptor protein involved in or regulating a tyrosine phosphorylation signaling cascade in the cell (e.g. T cell). In some embodiments, the provided immunomodulatory proteins contain at least two binding molecules: (1) an activating receptor binding molecule (ARBM) that is specific for an activating receptor or a ligand of the activating receptor and (2) an inhibitory receptor binding molecule (IRBM) that is specific for an inhibitory receptor. In some embodiments, the ARBM and IRBM are distinct or different polypeptides that independently bind different target cell surface molecules. In some aspects, the binding can occur simultaneously or in a non-competitive manner. In some embodiments, the activating receptor and inhibitory receptor are expressed on the same cell, e.g. a T cell, such that interactions of the ARBM and IRBM with their target cell surface molecules can physically proximalize the inhibitory receptor and activating receptor on the surface of the immune cells, e.g. T cell. In some cases, the close proximity of the inhibitory and activating receptors induced by binding of the immunomodulatory protein to its target cell surface molecules recruits a cytoplasmic protein tyrosine phosphatase to the intracellular region of the inhibitory receptor and/or favors phosphatase dependent phosphorylation of the activating receptor signaling cascades. In some embodiments, binding of the immunomodulatory protein to a target cell expressing the activating receptor and inhibitor receptor, such as a T cells, can lead to attenuation of immune responses, such as attenuation of T cell responses.

Figure 1B:
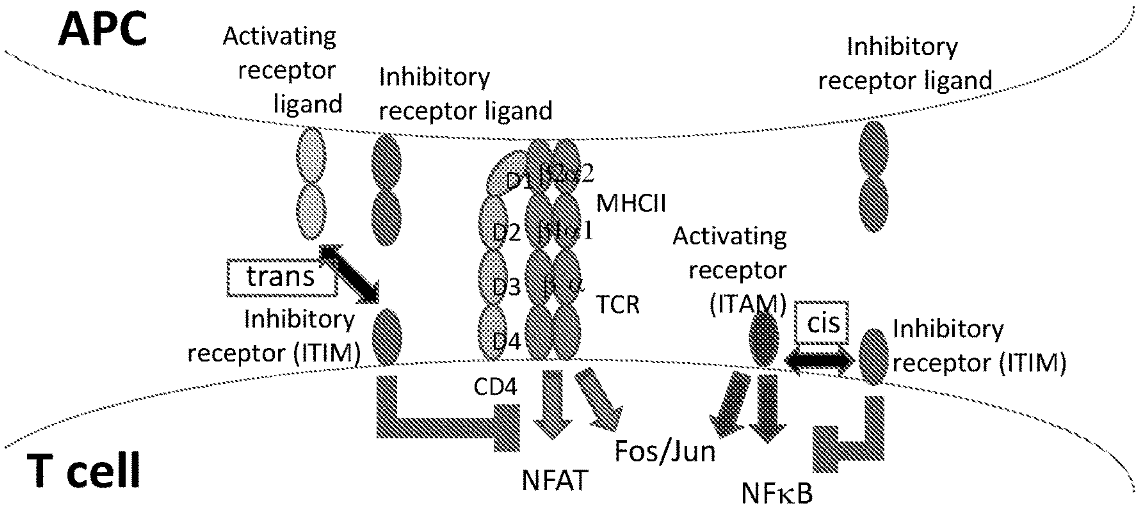
FIG. 1B depicts a cis binding strategy where the multi-domain immunomodulatory protein targets the inhibitory receptor (e.g. PD-1) and activating receptor (e.g. CD3, CD4 or CD28) on T cells, which, in some cases, proximalize or cluster the inhibitory receptor and the activating receptor on the surface of the same T cell and a trans binding strategy where the multi-domain immunomodulatory protein targets the inhibitory receptor (e.g. PD-1) on the T cell and a ligand of the activating receptor (e.g. CD80 or CD86) on an antigen-presenting cell (APC).

In some embodiments, the provided multi-domain immunomodulatory proteins can interact with the activating receptor/ligand in cis or in trans (FIGS. 1A and 1B). In some aspects, a cis strategy can be employed in which the IRBM binds to an inhibitory receptor (e.g. PD-1) and the ARBM binds to an activating receptor (e.g. CD3/CD4/CD28) on the surface of the same cell, e.g. same T cell. In some aspects, such embodiments benefit from the ability to bind multiple IS targets (e.g., an inhibitory and activating receptor) in a manner that is not dependent on the presence of other immune cells. In some aspects a trans strategy can be employed in which the IRBM binds an inhibitory receptor (e.g. PD-1) on a cell, e.g. T cell, that also expresses an activating receptor, and the ARBM binds to a ligand of the activating receptor found on another cell, such as an antigen presenting cell (APC). An exemplary immunomodulatory molecule that can act in a trans strategy includes one containing an IRBM that binds to an inhibitory receptor (e.g. PD-1) and an ARBM targeting a B7 costimulatory ligand (e.g. CD80 or CD86) on the APC to localize the CD28 costimulatory receptor and the inhibitory receptor to the immune synapse to attenuate the response. Similar trans strategies can use ARBM molecules targeting other activating ligands on an antigen presenting cell, such as an MHC molecule. In some cases, the trans strategy also may antagonize B7/CD28 signaling, thereby regulating TCR and CD28 activating signaling cascades.

In particular aspects, the provided immunomodulatory proteins provide an immunotherapy platform using binding domains of wild-type or affinity modified native immune ligands or receptors as the IRBM and/or ARBM component. In some aspects, the binding domain is or includes an immunoglobulin superfamily (IgSF) domain of an IgSF family member. In some aspects, the IgSF domain excludes those found in antibodies (i.e., immunoglobulins), such that the provided embodiments include embodiments that relate to immunomodulatory proteins containing non-immunoglobulin (i.e., non-antibody) IgSF domains. Wild-type mammalian IgSF family members that are not immunoglobulins (i.e. antibodies) are known as are their nucleic and amino acid sequences. In some embodiments, the non-immunoglobulin IgSF family members, and the corresponding IgSF domains present therein, are of mouse, rat, cynomolgus monkey, or human origin. In some embodiments, the IgSF family members are members of an IgSF subfamily such as: Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, or Killer-cell immunoglobulin-like receptors (KIR) family. For purposes herein, the IgSF domain is one whose binding partner is an activating receptor or a ligand of an activating receptor or is an inhibitory receptor.

In some embodiments, non-immunoglobulin IgSF family members, and the corresponding IgSF domains present therein, of an immunomodulatory proteins provided herein, are affinity-modified compared to a mammalian IgSF member. The affinity-modified IgSF domains include IgSF domains that are modified, such as by one or more amino acid substitution, to bind with tunable affinities to one or more of their cognate binding partner. An IgSF domain can be affinity modified to independently increase or decrease specific binding affinity or avidity to each of the multiple cognate binding partners to which it binds. By this mechanism, specific binding to each of multiple cognate binding partners is independently tuned to a particular affinity or avidity. Exemplary affinity-modified or variant IgSF domains having altered, such as increased, binding activity to one or more cognate binding partners are known (e.g. International published PCT App. Nos. WO 2016/168771, WO 2017/181148 and WO 2017/181152) or are described.

In some aspects, the provided immunomodulatory proteins containing one or more IgSF domain based on an immune system molecule, such as human immune system molecule, themselves are more likely to retain their ability to normally assemble into key pathways of the immune synapse and maintain normal interactions and regulatory functions, in part, because they are based on natural components of the immune synapse. Further, the relatively small molecular weight of individual IgSF domain may be beneficial in bringing two receptors together in close enough proximity, such as to induce or mediate phosphatase regulatory activity. Such features may not be possible with antibodies, including next-generation bispecific regents, due to the relatively large size of antibodies as well as from the fact that antibodies are not natural components of the immune synapse.

In some embodiments, the provided immunomodulatory proteins are single polypeptide fusions or monomers containing the IRBM or ARBM, which in some cases, can be tagged with a detectable moiety, such as a flag and/or his tag. In some aspects, such single polypeptide fusion or monomer formats minimize the size of the immunomodulatory protein and/or avoid steric issues that may result from other formats, including those involving larger molecules, such as dimeric molecules, e.g. molecules containing a multimerization domain, such as an Fc domain. In some cases, such polypeptide fusions can be made in various orientations, e.g. IRBM-ARBM or ARBM-IRBM, to create optimal binding pairs. Further, in some aspects, multiple IRBM and/or ARBM, such as independently two or more, such as 2, 3, 4, 5 or more IRBM or ARBM binding domain, e.g. IgSF domain, can be configured in a single polypeptide molecule to increase or improve binding affinity or avidity of one or both components, e.g. IRBM-IRBM-IRBM-ARBM.

In some aspects, the immunomodulatory proteins are provided as a dimeric protein. Generally, such formats are generated as a heterodimer, e.g. heterodimeric Fc fusion protein, such as to avoid dimeric binding of the activating receptor (e.g. CD28), which could result in unwanted firing of activating receptor. In some aspects, a heterodimeric immunomodulatory protein, while larger, may exhibit pharmacodynamics advantages, such as increased half-life.

In some aspects, the immunomodulatory proteins provided herein have therapeutic utility by attenuating immunological activity in a mammal with a disease or disorder in which modulation of the immune system response is beneficial. In some embodiments, the disease or condition is an inflammatory or autoimmune disease or condition.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described. Further various embodiments of the invention as discussed below are frequently provided. Thus, the headings, the order of presentation of the various aspects and embodiments, and the separate disclosure of each independent attribute is not meant to be a limitation to the scope of the present disclosure.

Definitions

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names are per IUPAC-IUB nomenclature. Unless indicated otherwise, all numerical ranges are inclusive of the values defining the range as well as all integer values in-between.

As used in the specification and the appended claims, the singular forms "a," "an," and "the" include plural referents unless the context clearly indicates otherwise.

The term "about" as used herein refers to the usual error range for the respective value readily known to the skilled person in this technical field. Reference to "about" a value or parameter herein includes (and describes) embodiments that are directed to that value or parameter per se. For example, description referring to "about X" includes description of "X".

As used herein, an "activating receptor" refers to a cell surface molecule in which engagement or ligation of the molecule results in the direct or indirect activation of one or more tyrosine kinases in an immune cell and/or culminates in the induction or potentiation of one or more effector cell functions in an immune cell in which it is expressed. An activating receptor generally contains an extracellular portion, a transmembrane domain and cytoplasmic region. In some embodiments, the cytoplasmic region contains an intracellular signaling domain that contains an immunoreceptor tyrosine-based activation motif (ITAM; defined by the sequence YXX(L/I)X6-8YXX(L/I)) or that otherwise is capable of interacting with or associating with one or more accessory proteins, such as one or more adaptor proteins, involved in or regulating tyrosine phosphorylation in a signal transduction pathway. In some cases, an activating receptor interacts with or associates with an adaptor protein that contains an ITAM or an adaptor protein that contains one or more protein-binding domains, such as e.g., Src homology 2 (SH2) and SH3 domains, that bind specific amino acid sequences, e.g phosphotyrosine residues, within a protein in a signal transduction pathway. Examples of adaptor proteins include, but are not limited to, Lck, Fyn, ZAP70, SLP76, PI3K, Grb2, PKCΘ and SHC1. Thus, it is understood that the activating receptor itself need not possess intrinsic enzymatic activity but may indirectly mediate enzymatic activities via accessory or adaptor proteins. In some embodiments, an activating receptor is a cell surface molecule on a T cell. Typically, engagement of an activating receptor initiates, mediates or potentiates activation of a cell resulting in a measurable morphological, phenotypic, and/or functional changes in the cell, such as a T cell, including cell proliferation, cytolytic activity, cytokine production or secretion, or expression of cell surface molecules such as receptors or adhesion molecules. In some embodiments, an activating receptor includes a T cell receptor (TCR), CD3, CD4, CD8, CD28, ICOS, or CD2.

The term "activating receptor binding molecule" or ARBM refers to a protein that specifically binds to an activating receptor or a ligand of an activating receptor.

The term "affinity-modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding activity, such as binding affinity or avidity, to at least one of its binding partners (alternatively "counter-structures") compared to the parental wild-type or unmodified (i.e., non-affinity modified) IgSF control domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a wild-type or unmodified IgSF domain. An increase or decrease in binding activity, e.g. binding affinity or avidity, can be determined using well known binding assays, including flow cytometry. Larsen et al., American Journal of Transplantation, Vol 5: 443-453 (2005). See also, Linsley et al., Immunity, 1: 7930801 (1994). An increase in a protein's binding activity, e.g. affinity or avidity, to its binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding activity, e.g. affinity or avidity, to at least one of its binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value. An affinity-modified protein is altered in primary amino acid sequence by substitution, addition, or deletion of amino acid residues. The term "affinity-modified IgSF domain" is not be construed as imposing any condition for any particular starting composition or method by which the affinity-modified IgSF domain was created. Thus, the affinity-modified IgSF domains of the present invention are not limited to wild-type IgSF domains that are then transformed to an affinity-modified IgSF domain by any particular process of affinity modification. An affinity-modified IgSF domain polypeptide can, for example, be generated starting from wild-type mammalian IgSF domain sequence information, then modeled in silico for binding to its binding partner, and finally recombinantly or chemically synthesized to yield the affinity-modified IgSF domain composition of matter. In but one alternative example, an affinity-modified IgSF domain can be created by site-directed mutagenesis of a wild-type IgSF domain. Thus, affinity modified IgSF domain denotes a product and not necessarily a product produced by any given process. A variety of techniques including recombinant methods, chemical synthesis, or combinations thereof, may be employed.

The term "allogeneic" as used herein means a cell or tissue that is removed from one organism and then infused or adoptively transferred into a genetically dissimilar organism of the same species.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which is removed from the organism. For example, a native autologous T-cell can be genetically engineered by recombinant DNA techniques to become an autologous engineered cell expressing a immunomodulatory protein (which can be secreted from the engineered cell), which in some cases involves engineering a T-cell or TIL (tumor infiltrating lymphocyte). The engineered cell can then be infused into a patient from which the native T-cell was isolated. In some embodiments, the organism is human or murine.

As used herein, "bind," "bound" or grammatical variations thereof refers to the participation of a molecule in any attractive interaction with another molecule, resulting in a stable association in which the two molecules are in close proximity to one another. Binding includes, but is not limited to, non-covalent bonds, covalent bonds (such as reversible and irreversible covalent bonds), and includes interactions between molecules such as, but not limited to, proteins, nucleic acids, carbohydrates, lipids, and small molecules, such as chemical compounds including drugs.

As used herein, binding activity refer to characteristics of a molecule, e.g. a polypeptide, relating to whether or not, and how, it binds one or more binding partners. A binding activity can include any measure of binding of one molecule for a binding partner. Binding activities include the ability to bind the binding partner(s), the affinity with which it binds to the binding partner (e.g. high affinity), the avidity with which it binds to the binding partner, the strength of the bond with the binding partner and/or specificity or selectivity for binding with the binding partner.

The term "binding affinity" as used herein means the specific binding affinity of a protein for its binding partner (i.e., its counter-structure) under specific binding conditions. The binding affinity refers to the strength of the interaction between two or more molecules, such as binding partners, typically the strength of the noncovalent interactions between two binding partners. An increase or attenuation in binding affinity of an affinity-modified IgSF domain, or an immunomodulatory protein containing an affinity-modified IgSF domain, to a binding partner is determined relative to the binding affinity of the unmodified IgSF domain (e.g., the native or wild-type IgSF domain). Methods for determining binding affinity, or relative binding affinity, are known in art, solid-phase ELISA immunoassays, ForteBio Octet, Biacore measurements or flow cytometry. See, for example, Larsen et al., American Journal of Transplantation, vol. 5: 443-453 (2005); Linsley et al., Immunity, Vol 1 (9): 793-801 (1994). In some embodiments, binding affinity can be measured by flow cytometry, such as based on a Mean Fluorescence Intensity (MFI) in a binding assay.

The term "binding avidity" as used herein means the specific binding avidity, of a protein for its binding partner (i.e., its counter-structure) under specific binding conditions. In biochemical kinetics avidity refers to the accumulated strength of multiple affinities of individual non-covalent binding interactions, such as between an IgSF domain and its binding partner (i.e., its counter-structure). As such, avidity is distinct from affinity, which describes the strength of a single interaction.

The term "biological half-life" refers to the amount of time it takes for a substance, such as an immunomodulatory protein, to lose half of its pharmacologic or physiologic activity or concentration. Biological half-life can be affected by elimination, excretion, degradation (e.g., enzymatic degradation/digestion) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of a protein are known in the art and include, but are not limited to, multimerization domains (e.g. Fc), polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), polyglutamic acid (glutamylation).

The term "cell surface counter-structure" (alternatively "cell surface binding partner") as used herein is a counter-structure (alternatively is a binding partner) expressed on a mammalian cell. Typically, the cell surface binding partner is a transmembrane protein. In some embodiments, the cell surface binding partner is a receptor.

The terms "binding partner" or "counter-structure" in reference to a protein, such as an IgSF domain or an affinity-modified IgSF domain, refers to at least one molecule (typically a native mammalian protein) to which the referenced protein specifically binds under specific binding conditions. In some aspects, an affinity-modified IgSF domain, or an immunomodulatory protein containing an affinity-modified IgSF domain, specifically binds to the binding partner of the corresponding native or wild-type IgSF domain but with increased or attenuated affinity. A "cell surface binding partner" is a binding partner expressed on a mammalian cell. Typically, the cell surface binding partner is a transmembrane protein. In some embodiments, the cell surface binding partner is a receptor or a ligand of a receptor expressed on and by cells, such as mammalian cells, forming the immunological synapse, for example immune cells.

The term "cis" with reference to binding to cell surface molecules refers to binding to two or more different cell surface molecules, each of which is present on the surface of the same cell. In some embodiments, cis means that the two or more cell surface molecules are exclusively on one or exclusively the other (but not both) of the two mammalian cells forming the IS.

The term "competitive binding" as used herein means that a protein is capable of specifically binding to at least two binding partners but that specific binding of one binding partner inhibits, such as prevents or precludes, simultaneous binding of the second binding partner. Thus, in some cases, it is not possible for a protein to bind the two binding partners at the same time. Generally, competitive binders contain the same or overlapping binding site for binding but this is not a requirement. In some embodiments, competitive binding causes a measurable inhibition (partial or complete) of specific binding of a protein to one of its binding partner due to specific binding of a second binding partner. A variety of methods are known to quantify competitive binding such as ELISA (enzyme linked immunosorbent assay) or ForteBio Octet experimental systems.

The term "conservative amino acid substitution" as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, "corresponding to" with reference to positions of a protein, such as recitation that nucleotides or amino acid positions "correspond to" nucleotides or amino acid positions in a disclosed sequence, such as set forth in the Sequence Listing, refers to nucleotides or amino acid positions identified upon alignment with the disclosed sequence based on structural sequence alignment or using a standard alignment algorithm, such as the GAP algorithm. By aligning the sequences, one skilled in the art can identify corresponding residues, for example, using conserved and identical amino acid residues as guides.

The term "cytokine" includes, e.g., but is not limited to, interleukins, interferons (IFN), chemokines, hematopoietic growth factors, tumor necrosis factors (TNF), and transforming growth factors. In general, these are small molecular weight proteins that regulate maturation, activation, proliferation, and differentiation of cells of the immune system.

The terms "decreased," "reduced," "suppressed" or "inhibits," which can be used interchangeably, as used herein in the context of an immunological activity of a mammalian lymphocyte in the presence of a provided immunomodulatory protein means to decrease one or more activities of the lymphocyte, as compared to a control, such as an untreated control or a control involving treatment with another molecule, such as a molecule containing an individual IgSF domain of an immunomodulatory protein or an alternative molecule, was employed under the same conditions. A decreased activity can refer to one or more of cell cycle inhibition, reduced cell survival, reduced cell proliferation, reduced cytokine production, or reduced T-cell cytotoxicity, such as by a statistically significant amount. In some embodiments, reference to reduced immunological activity means to reduce interferon gamma (IFN-gamma) production compared to in the absence of treatment, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments, a decrease can be by at least 5%, 10%, 15%, 20%, 25%, 30%, 35%, 40%, 45%, 50%, 60%, 70%, 80%, 90%, or 100%, as compared to a control value, such as an untreated control value or a non-zero control value.

The terms "derivatives" or "derivatized" refer to modification of an immunomodulatory protein by covalently linking it, directly or indirectly, so as to alter such characteristics as half-life, bioavailability, immunogenicity, solubility, toxicity, potency, or efficacy while retaining or enhancing its therapeutic benefit. Derivatives can be made by glycosylation, pegylation, lipidation, or Fc-fusion. In some embodiments, the immunomodulatory protein is not derivatized. In some embodiments, the immunomodulatory protein is not conjugated to a half-life extending moiety, such as an Fc domain.

As used herein, "domain" (typically a sequence of three or more, generally 5 or 7 or more amino acids, such as 10 to 200 amino acid residues) refers to a portion of a molecule, such as a protein or encoding nucleic acid, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a cognate binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Also, in some cases, adjacent N- and/or C-terminal amino acids of a given domain (e.g. ECD or IgV) also can be included in a sequence of an IgSF domain, such as to ensure proper folding of the domain when expressed. Thus, the exact locus can vary, and is not necessarily the same for each protein. Hence, the specific IgSF domain, such as specific IgV domain or IgC domain, can be several amino acids (1-10, such as 1, 2, 3, 4, 5, 6, 7, 8, 9 or 10 amino acids) longer or shorter.

The term "ectodomain," "extracellular domain," or "ECD," which are used interchangeably herein, refers to the region of a membrane protein, such as a transmembrane protein, that lies outside the vesicular membrane (e.g., the space outside of a cell). Ectodomains often interact with specific ligands or specific cell surface receptors, such as via a binding domain that specifically binds to the ligand or cell surface receptor. Ectodomains of members of the immunoglobulin superfamily contain immunoglobulin domains.

The terms "effective amount" or "therapeutically effective amount" refer to a quantity and/or concentration of a therapeutic composition of the invention, such as containing an immunomodulatory protein or engineered cells expressing an immunomodulatory protein, that when administered ex vivo (by contact with a cell from a patient) or in vivo (by administration into a patient) either alone (i.e., as a monotherapy) or in combination with additional therapeutic agents, yields a statistically significant inhibition of disease progression as, for example, by ameliorating or eliminating symptoms and/or the cause of the disease. An effective amount for treating a disease or disorder, such as an immune system disease or disorder, may be an amount that relieves, lessens, or alleviates at least one symptom or biological response or effect associated with the disease or disorder, prevents progression of the disease or disorder, or improves physical functioning of the patient. In the case of cell therapy, the effective amount is an effective dose or number of cells administered to a patient. In some embodiments the patient is a human patient.

The term “endodomain” as used herein refers to the region found in some membrane proteins, such as transmembrane proteins, that extends into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain.

The term “enhanced” or “increased,” which can be used interchangeably, as used herein in the context of increasing immunological activity of a mammalian lymphocyte in the presence of a molecule means to increase one or more activities of the lymphocyte. An increased activity can be one or more of an increase cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. Typically, the increase is relative to or compared to a control, such as an untreated control or a control involving treatment with another molecule. Methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a non-zero control value.

The term “engineered cell” as used herein refers to a mammalian cell that has been genetically modified by human intervention such as by recombinant DNA methods or viral transduction. In some embodiments, the engineered cell is an immune cell, such as a lymphocyte (e.g. T cell, B cell, NK cell) or an antigen presenting cell (e.g. dendritic cell). The cell can be a primary cell from a patient or can be a cell line. In some embodiments, an engineered cell is capable of expressing and secreting a immunomodulatory protein as described herein.

The term “engineered T-cell” as used herein refers to a T-cell such as a T helper cell, cytotoxic T-cell (alternatively, cytotoxic T lymphocyte or CTL), natural killer T-cell, regulatory T-cell, memory T-cell, or gamma delta T-cell, that has been genetically modified by human intervention such as by recombinant DNA methods. In some embodiments, an engineered T-cell is capable of expressing and secreting an immunomodulatory protein as described herein.

As used herein, a fusion protein refers to a polypeptide encoded by a nucleic acid sequence containing a coding sequence for two or more proteins, in some cases 2, 3, 4, 5 or more protein, in which the coding sequences are in the same reading frame such that when the fusion construct is transcribed and translated in a host cell, the protein is produced containing the two or more proteins. Each of the two or more proteins can be adjacent to another protein in the construct or separated by a linker polypeptide that contains, 1, 2, 3, or more, but typically fewer than 20, 15, 10, 9, 8, 7, or 6 amino acids. The protein product encoded by a fusion construct is referred to as a fusion polypeptide.

The term “half-life extending moiety” refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), and polyglutamic acid (glutamylation).

An Fc (fragment crystallizable) region or domain of an immunoglobulin molecule (also termed an Fc polypeptide) corresponds largely to the constant region of the immunoglobulin heavy chain, and is responsible for various functions, including the antibody’s effector function(s). The Fc domain contains part or all of a hinge domain of an immunoglobulin molecule plus a CH2 and a CH3 domain. The Fc domain can form a dimer of two polypeptide chains joined by one or more disulfide bonds. In some embodiments, the Fc is a variant Fc that exhibits reduced (e.g. reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics information System®, http://www.imgt.org/IMGTScientificChart/Numbering/Hu_IGHGnber.html (created: 17 May 2001, last updated: 10 Jan. 2013) and the EU index as reported in Kabat, E. A. et al. Sequences of Proteins of Immunological interest. 5th ed. US Department of Health and Human Services, NIH publication No. 91-3242 (1991).

An immunoglobulin Fc fusion (“Fc-fusion”), such as an immunomodulatory Fc fusion protein, is a molecule comprising one or more polypeptides operably linked to an Fc region of an immunoglobulin. An Fc-fusion may comprise, for example, the Fc region of an antibody (which facilitates effector functions and pharmacokinetics) operably linked to an ARBM or IRBM of the provided immunomodulatory proteins. An immunoglobulin Fc region may be linked indirectly or directly to the ARBM and/or IRBM. Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine or human Fc.

The term “host cell” refers to any cell that can be used to express a protein encoded by a recombinant expression vector. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO and related cell lines which grow in serum-free media or CHO strain DX-B11, which is deficient in DHFR.

The term "immunological synapse" or "immune synapse" (abbreviated "IS") as used herein means the interface between a mammalian cell that expresses MHC I (major histocompatibility complex) or MHC II, such as an antigen-presenting cell or tumor cell, and a mammalian lymphocyte such as an effector T cell or Natural Killer (NK) cell.

The term "immunoglobulin" (abbreviated "Ig") as used herein is synonymous with the term "antibody" (abbreviated "Ab") and refers to a mammalian immunoglobulin protein including any of the five human classes: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, including any fragment thereof containing at least a portion of the variable heavy (VH) chain and/or variable light (VL) chain region of the immunoglobulin molecule that is sufficient to form an antigen binding site and, when assembled, to specifically bind antigen. The antibody also can include all or a portion of the constant region. Such fragments include antigen binding fragment (Fab), variable fragment (Fv) containing VH and VL, the single chain variable fragment (scFv) containing VH and VL linked together in one chain, as well as other antibody V region fragments, such as Fab', F(ab)2, F(ab')2, dsFv diabody, Fc, and Fd polypeptide fragments. Hence, it is understood that reference to an antibody herein includes full-length antibody and antigen-binding fragments. The term antibody also includes antibody compositions with polyepitopic specificity, multispecific antibodies (e.g., bispecific antibodies), diabodies, and single-chain molecules. Bispecific antibodies, homobispecific and heterobispecific, are included within the meaning of the term. Antibodies include polyclonal antibodies or monoclonal antibodies. Antibody also includes synthetic antibodies or recombinantly produced antibodies. For the structure and properties of the different classes of antibodies, see e.g., *Basic and Clinical Immunology,* 8th Edition, Daniel P. Sties, Abba I. Ten and Tristram G. Parsolw (eds), Appleton & Lange, Norwalk, CT, 1994, page 71 and Chapter 6.

The terms "full-length antibody," "intact antibody" or "whole antibody" are used interchangeably to refer to an antibody in its substantially intact form, as opposed to an antibody fragment. A full-length antibody is an antibody typically having two full-length heavy chains (e.g., VH-CH1-CH2-CH3 or VH-CH1-CH2-CH3-CH4) and two full-length light chains (VL-CL) and hinge regions, such as antibodies produced from mammalian species (e.g. human, mouse, rat, rabbit, non-human primate, etc.) by antibody secreting B cells and antibodies with the same domains that are produced synthetically. Specifically whole antibodies include those with heavy and light chains including an Fc region. The constant domains may be native sequence constant domains (e.g., human native sequence constant domains) or amino acid sequence variants thereof. In some cases, the intact antibody may have one or more effector functions.

An "antibody fragment" comprises a portion of an intact antibody, the antigen binding and/or the variable region of the intact antibody. Antibody fragments, include, but are not limited to, Fab fragments, Fab' fragments, $F(ab')_2$ fragments, Fv fragments, disulfide-linked Fvs (dsFv), Fd fragments, Fd' fragments; diabodies; linear antibodies (see U.S. Pat. No. 5,641,870, Example 2; Zapata et al., *Protein Eng.* 8(10): 1057-1062 [1995]); single-chain antibody molecules, including single-chain Fvs (scFv) or single-chain Fabs (scFab); antigen-binding fragments of any of the above and multispecific antibodies from from antibody fragments.

"Fv" is composed of one heavy- and one light-chain variable region domain linked by non-covalent association. From the folding of these two domains emanate six complementarity determining regions (CDR) (3 in each from the heavy and light chain) that contribute the amino acid residues for antigen binding and confer antigen binding specificity to the antibody. However, even a single variable domain (or half of an Fv comprising only three CDRs specific for an antigen) has the ability to recognize and bind antigen, although, in some cases, at a lower affinity than the entire binding site.

"dsFv" refers to an Fv with an engineered intermolecular disulfide bond, which stabilizes the $V_H$-$V_L$ pair.

An "Fd fragment" is a fragment of an antibody containing a variable domain ($V_H$) and one constant region domain ($C_H1$) of an antibody heavy chain.

A "Fab fragment" is an antibody fragment that results from digestion of a full-length immunoglobulin with papain, or a fragment having the same structure that is produced synthetically, e.g., by recombinant methods. A Fab fragment contains a light chain (containing a $V_L$ and $C_L$) and another chain containing a variable domain of a heavy chain ($V_H$) and one constant region domain of the heavy chain ($C_H1$).

A "$F(ab')_2$ fragment" is an antibody fragment that results from digestion of an immunoglobulin with pepsin at pH 4.0-4.5, or a fragment having the same structure that is produced synthetically, e.g., by recombinant methods. The $F(ab')_2$ fragment essentially contains two Fab fragments where each heavy chain portion contains an additional few amino acids, including cysteine residues that form disulfide linkages joining the two fragments.

A "Fab' fragment" is a fragment containing one half (one heavy chain and one light chain) of the $F(ab')_2$ fragment.

An "Fd' fragment" is a fragment of an antibody containing one heavy chain portion of a $F(ab')_2$ fragment.

An "Fv' fragment" is a fragment containing only the $V_H$ and $V_L$ domains of an antibody molecule.

An "scFv fragment" refers to an antibody fragment that contains a variable light chain ($V_L$) and variable heavy chain ($V_H$), covalently connected by a polypeptide linker in any order. The linker is of a length such that the two variable domains are bridged without substantial interference. Exemplary linkers are $(Gly\text{-}Ser)_n$ residues with some Glu or Lys residues dispersed throughout to increase solubility.

"Diabodies" are dimeric scFv; diabodies typically have shorter peptide linkers than scFvs, and preferentially dimerize.

The term "immunoglobulin superfamily" or "IgSF" as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Many "non-antibody IgSF" members include cell surface proteins or receptors that are not antibodies. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into "subfamilies" based on shared properties such as function. Such subfamilies typically include from 4 to 30 IgSF members.

The terms "IgSF domain" or "immunoglobulin domain" or "Ig domain" or "IgD" as used herein refers to a structural domain or domains of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands, stabilize the Ig-fold. In some cases, one end of the Ig domain has a section called the complementarity determining region, which, in some aspects, is involved in the specificity of antibodies for their ligands. The Ig like domains can be classified (into classes) as: IgV, IgC1, IgC2, or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. A "non-antibody IgSF domain" refers to IgSF domain or domains present in proteins other than antibodies, which typically are present in the extracellular portion or domain of certain cell surface proteins. Thus, the extracellular domain (ECD) of IgSF family members contains one or more Ig domains; hence, the term Ig domain is also used with reference to the ECD of such protein molecules.

The term "immunological activity" as used herein in the context of mammalian lymphocytes, such as T cells, refers to one or more of activation, cell survival, cell proliferation, cytokine production (e.g. interferon-gamma), or T-cell cytotoxicity activities. Assays for determining enhancement or suppression of immunological activity include MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B), T cell stimulation assays (Wang et al., Cancer Immunol Res. 2014 September: 2(9):846-56), and anti-CD3 T cell stimulation assays (Li and Kurlander, J Transl Med. 2010: 8: 104). Since T cell activation is associated with secretion of IFN-gamma cytokine, detecting IFN-gamma levels in culture supernatants from these in vitro human T cell assays can be assayed using commercial ELISA kits (Wu et al, Immunol Lett 2008 Apr. 15; 117(1): 57-62). Assays also include assays to assess cytotoxicity, including a standard 51Cr-release assay (see e.g. Milone et al., (2009) Molecular Therapy 17: 1453-1464) or flow based cytotoxicity assays, or an impedance based cytotoxicity assay (Peper et al. (2014) Journal of Immunological Methods, 405:192-198). Assays to assess immunological activity of immunomodulatory proteins can be compared to control proteins with a known activity.

An "immunomodulatory protein" or "immunomodulatory polypeptide" is a protein that modulates immunological activity. By "modulation" or "modulating" an immune response is meant that immunological activity is either enhanced or suppressed. An immunomodulatory protein can be a single polypeptide chain or a multimer (dimers or higher order multimers) of at least two polypeptide chains covalently bonded to each other by, for example, interchain disulfide bonds. Thus, monomeric, dimeric, and higher order multimeric proteins are within the scope of the defined term. Multimeric proteins can be homomultimeric (of identical polypeptide chains) or heteromultimeric (of different polypeptide chains). Secretable immunomodulatory proteins are a type of immunomodulatory protein.

As used herein, an "inhibitory receptor" refers to a cell surface molecule in which engagement of the molecule transmits a negative signal to an immune cell and/or down-regulates or reduces activation of an immune cell. In some embodiments, transmission of an inhibitory signal to an immune cell can result in unresponsiveness or anergy or programmed cell death in the immune cell. An inhibitory receptor generally contains an extracellular portion, a transmembrane domain and a cytoplasmic region that directly or indirectly activates or recruits phosphatases. In some embodiments, the cytoplasmic region contains an immunoreceptor tyrosine-based inhibition motif (ITIM), which is a conserved sequence of amino acids (S/I/V/LxYxxI/V/L) that is found in the cytoplasmic tails of many inhibitory receptors of the immune system. In some aspects, engagement of an ITIM-containing receptor, such as with a ligand, results in phosphorylation of the ITIM motif to recruit SH2-domain containing phosphatases, such as the phosphotyrosine phosphatases SHP-1 and SHP-2 or the inositol-phosphatase called SHIP. In some aspects, the phosphatases can dephosphorylate kinases associated with ITAM-mediated cell activation, thereby attenuating signaling and effector functions mediated by an activating receptor, such as inhibition or reduction of proliferation, cytokine production or secretion or cytotoxic activity. In some embodiments, an inhibitory receptor includes PD-1, CTLA-4 or TIGIT.

The term "inhibitory receptor binding molecule" or IRBM refers to a protein that specifically binds to an inhibitory receptor.

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include T helper cells, cytotoxic T-cells, natural killer T-cells, memory T-cells, regulatory T-cells, or gamma delta T-cells. Innate lymphoid cells (ILC) are also included within the definition of lymphocyte.

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," "subject," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an "integral monotopic protein". An integral membrane protein that interacts with both lipid bilayers is an "integral polytopic protein" alternatively referred to herein as a "transmembrane protein".

As used herein, modification is in reference to modification of a sequence of amino acids of a polypeptide or a sequence of nucleotides in a nucleic acid molecule and includes deletions, insertions, and replacements of amino acids and nucleotides, respectively. Methods of modifying a polypeptide are routine to those of skill in the art, such as by using recombinant DNA methodologies.

The terms "modulating" or "modulate" as used herein in the context of an immune response, such as a mammalian immune response, refer to any alteration, such as an increase or decrease, of an existing or potential immune responses that occurs as a result of administration of an immunomodulatory protein or as a result of administration of engineered cells expressing an immunomodulatory protein, such as a secretable immunomodulatory protein of the present invention. Such modulation includes any induction, or alteration in degree or extent, or suppression of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils). Modulation includes any change imparted on an existing immune response, a developing immune response, a potential immune response, or the capacity to induce, regulate, influence, or respond to an immune response. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; proliferation, induction, survival or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, perforins, granzymes, growth factors, transcription factors, kinases, costimulatory molecules, or other cell surface receptors or any combination of these modulatory events. Modulation can be assessed, for example, by an alteration of an immunological activity.

The term, a "multimerization domain" refers to a sequence of amino acids that promotes stable interaction of a polypeptide molecule with one or more additional polypeptide molecules, each containing a complementary multimerization domain (e.g. a first multimerization domain and a second multimerization domain), which can be the same or a different multimerization domain. The interactions between complementary multimerization domains, e.g. interaction between a first multimerication domain and a second multimerization domain, form a stable protein-protein interaction to produce a multimer of the polypeptide molecule with the additional polypeptide molecule. In some cases, the multimerization domain is the same and interacts with itself to form a stable protein-protein interaction between two polypeptide chains. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The term "non-competitive binding" as used herein means the ability of a protein to specifically bind simultaneously to at least two binding partners. In some embodiments, the binding occurs under specific binding conditions. Thus, the protein is able to bind to at least two different binding partners at the same time although the binding interaction need not be for the same duration such that, in some cases, the protein is specifically bound to only one of the binding partners. In some embodiments, the simultaneous binding is such that binding of one binding partner does not substantially inhibit simultaneous binding to a second binding partner. In some embodiments, non-competitive binding means that binding a second binding partner to its binding site on the protein does not displace the binding of a first binding partner to its binding site on the protein. Methods of assessing non-competitive binding are well known in the art such as the method described in Perez de La Lastra et al., Immunology, 1999 April: 96(4): 663-670. In some cases, in non-competitive interactions, the first binding partner specifically binds at an interaction site that does not overlap with the interaction site of the second binding partner such that binding of the second binding partner does not directly interfere with the binding of the first binding partner. Thus, any effect on binding of the binding partner by the binding of the second binding partner is through a mechanism other than direct interference with the binding of the first binding partner. For example, in the context of enzyme-substrate interactions, a non-competitive inhibitor binds to a site other than the active site of the enzyme. Non-competitive binding encompasses uncompetitive binding interactions in which a second binding partner specifically binds at an interaction site that does not overlap with the binding of the first binding partner but binds to the second interaction site only when the first interaction site is occupied by the first binding partner.

The terms "nucleic acid" and "polynucleotide" are used interchangeably to refer to a polymer of nucleic acid residues (e.g., deoxyribonucleotides or ribonucleotides) in either single- or double-stranded form. Unless specifically limited, the terms encompass nucleic acids containing known analogues of natural nucleotides and that have similar binding properties to it and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated. Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The terms "in operable combination," "in operable order" and "operably linked" as used herein refer to the linkage of nucleic acid sequences in such a manner or orientation that the segments are arranged so that they function in concert for their intended purposes. In some embodiments, the term refers to linkage of nucleic acids to produce a nucleic acid molecule capable of directing the transcription of a given gene and/or to produce a desired protein molecule that is functional. For example, segments of a DNA sequence, e.g. a coding sequence and a regulatory sequence(s), are linked in such a way as to permit gene expression when the appropriate molecules (e.g. transcriptional activator proteins) are bound to the regulatory sequence.

The term "pharmaceutical composition" refers to a composition suitable for pharmaceutical use in a mammalian subject, often a human. A pharmaceutical composition typically comprises an effective amount of an active agent (e.g., an immunomodulatory protein or engineered cells expressing and/or secreting an immunomodulatory protein of the present invention) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylations, acetylations, phosphorylations and the like. The terms also include molecules in which one or more amino acid analogs or non-canonical or unnatural amino acids are included as can be synthesized, or expressed recombinantly using known protein engineering techniques. In addition, proteins can be derivatized as described herein by well-known organic chemistry techniques.

The term "primary T-cell assay" as used herein refers to an in vitro assay to measure interferon-gamma ("IFN-gamma") expression. A variety of such primary T-cell assays are known in the art. In some embodiments, the assay used is anti-CD3 coimmobilization assay. In this assay, primary T cells are stimulated by anti-CD3 immobilized with or without additional recombinant proteins. Culture supernatants are harvested at timepoints, usually 24-72 hours. In another embodiment, the assay used is a mixed lymphocyte reaction (MLR). In this assay, primary T cells are simulated with allogenic APC. Culture supernatants are harvested at timepoints, usually 24-72 hours. Human IFN-gamma levels are measured in culture supernatants by standard ELISA techniques. In some cases, commercial kits are available from vendors and the assay can be performed according to manufacturer's recommendation.

The term "purified" as applied to nucleic acids, such as encoding immunomodulatory proteins, or proteins (e.g. immunomodulatory proteins) generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule (e.g., an immunomodulatory protein) which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest.

The term "recombinant expression vector" as used herein refers to a DNA molecule containing a desired coding sequence (e.g., encoding an immunomodulatory protein) and appropriate nucleic acid sequences necessary for the expression of an operably linked coding sequence in a particular cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence so that the expressed protein can be secreted by the recombinant host cell, such as for its expression as a secretable protein or for more facile isolation or purification of the immunomodulatory protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one binding partner, compared to specific binding for another substrate, such as a different binding partner of the subject protein. Selectivity can be reflected as a ratio of the binding activity (e.g. binding affinity) of a subject protein and a first substrate, such as a first binding partner, (e.g., $K_{d1}$) and the binding activity (e.g. binding affinity) of the same subject protein with a second binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, BLAST-2, ALIGN or Megalign (DNASTAR) software, FASTA and TFASTA. The BLAST algorithm calculates percent sequence identity and performs a statistical analysis of the similarity between the two sequences. The software for performing BLAST analysis is publicly available through the National Center for Biotechnology Information (NCBI) website. In some cases, a percent sequence identity can be determined as the percentage of amino acid residues (or nucleotide residues) in a candidate sequence that are identical with the amino acid residues (or nucleotide residues) in a reference sequence, after aligning the sequences and introducing gaps, if necessary, to achieve the maximum percent sequence identity. Those skilled in the art can determine appropriate parameters for aligning sequences, including any algorithms needed to achieve maximal alignment over the full length of the sequences being compared.

The term "soluble" as used herein in reference to proteins, means that the protein is not a membrane protein. In some cases, a soluble protein contains only an extracellular domain of an IgSF family member or members, or a portion thereof containing an IgSF domain or domains or specific-binding fragments thereof, but does not contain a transmembrane domain. In some cases, solubility of a protein can be improved by linkage or attachment, directly or indirectly via a linker, to an Fc domain, which, in some cases, also can improve the stability and/or half-life of the protein. In some aspects, a soluble protein is an Fc fusion protein.

The term "specifically binds" as used herein means the ability of a protein, under specific binding conditions, to bind to a target protein such that its affinity or avidity is at least 10 times as great, but optionally 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to more than one target molecule. In some cases, a specifically binding protein may bind to a protein that has similarity in structural conformation with the target protein (e.g., paralogs or orthologs). Those of skill will recognize that specific binding to a molecule having the same function in a different species of animal (i.e., ortholog) or to a molecule having a substantially similar epitope as the target molecule (e.g., paralog) is possible and does not detract from the specificity of binding which is determined relative to a statistically valid collection of unique non-targets (e.g., random polypeptides). Thus, an immunomodulatory protein of the invention, or an ARBM or IRBM thereof, may specifically bind to more than one distinct species of target molecule due to cross-reactivity. Solid-phase ELISA immunoassays, ForteBio Octet or Biacore measurements can be used to determine specific binding between two proteins. Generally, interactions between two binding proteins have dissociation constants (Kd) less than about $1\times10^{-5}$ M, and often as low as about $1\times10^{-12}$ M. In certain aspects of the present disclosure, interactions between two binding proteins have dissociation constants of less than about $1\times10^{-6}$ M, $1\times10^{-7}$ M, $1\times10^{-8}$ M, $1\times10^{-9}$ M, $1\times10^{-10}$ M, or $1\times10^{-11}$ M or less.

The term "specific binding fragment" or "fragment" as used herein in reference to a protein means a polypeptide that is shorter than a full-length protein or a specific domain or region thereof and that specifically binds in vitro and/or in vivo to a binding partner of the full-length protein or of the specific domain or region. In some cases, a specific binding fragment is in reference to a fragment of a full-length IgSF family member or a full-length IgSF domain thereof (e.g. IgV or IgC), but that still binds to a binding partner of the IgSF family member or of an IgSF domain of an IgSF family member. In some embodiments, the specific binding fragment is at least 20%, 30%, 40%, 50%, 60%, 70%, 75%, 80%, 85%, 90%, 95%, 96%, 97%, 98%, or 99% the sequence length of the full-length sequence or of a domain or region of an IgSF family member. In some embodiments, the specific binding fragment can have an amino acid length of at least 50 amino acids, such as at least 60, 70, 80, 90, 100, or 110 amino acids. The specific binding fragment can be altered in sequence to form an affinity modified IgSF domain.

As used herein, a "subject" is a mammal, such as a human or other animal, and typically is human. The subject can be male or female and can be any suitable age, including infant, juvenile, adolescent, adult, and geriatric subjects.

The terms "surface expresses" or "surface expression" in reference to a mammalian cell expressing a polypeptide means that the polypeptide is expressed as a membrane protein. In some embodiments, the membrane protein is a transmembrane protein.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

The term "trans" with reference to binding to cell surface molecules refers to binding to two different cell surface molecules, each of which is present on the surface of a different cell. In some embodiments, trans means that with respect to two different cell surface molecules, the first is exclusively present on one of the two mammalian cells forming the IS and the second is present exclusively on the second of the two mammalian cells forming the IS.

The term "transmembrane protein" as used herein means a membrane protein that substantially or completely spans a lipid bilayer such as those lipid bilayers found in a biological membrane such as a mammalian cell, or in an artificial construct such as a liposome. The transmembrane protein comprises a transmembrane domain ("transmembrane domain") by which it is integrated into the lipid bilayer and by which the integration is thermodynamically stable under physiological conditions. Transmembrane domains are generally predictable from their amino acid sequence via any number of commercially available bioinformatics software applications on the basis of their elevated hydrophobicity relative to regions of the protein that interact with aqueous environments (e.g., cytosol, extracellular fluid). A transmembrane domain is often a hydrophobic alpha helix that spans the membrane. A transmembrane protein can pass through the both layers of the lipid bilayer once or multiple times.

The terms "treating," "treatment," or "therapy" of a disease or disorder as used herein mean slowing, stopping or reversing the disease or disorders progression, as evidenced by decreasing, cessation or elimination of either clinical or diagnostic symptoms, by administration of an immunomodulatory protein or engineered cells of the present invention either alone or in combination with another compound as described herein. "Treating," "treatment," or "therapy" also means a decrease in the severity of symptoms in an acute or chronic disease or disorder or a decrease in the relapse rate as for example in the case of a relapsing or remitting autoimmune disease course or a decrease in inflammation in the case of an inflammatory aspect of an autoimmune disease. "Preventing," "prophylaxis," or "prevention" of a disease or disorder as used in the context of this invention refers to the administration of an immunomodulatory protein or engineered cells expressing an immunomodulatory protein of the present invention, either alone or in combination with another compound, to prevent the occurrence or onset of a disease or disorder or some or all of the symptoms of a disease or disorder or to lessen the likelihood of the onset of a disease or disorder.

The term "variant" (also "modified" or mutant," which can be used interchangeably) as used in reference to a variant protein or polypeptide, such as a variant of an IgSF family member or IgSF domain thereof, means a protein, such as a mammalian (e.g., human or murine) protein created by human intervention. The variant is a polypeptide having an altered or modified amino acid sequence, such as by one or more amino acid substitutions, deletions, additions or combinations thereof, relative to an unmodified or wild-type protein or to a domain (e.g. IgSF domain, such as an IgV domain) thereof. A variant polypeptide can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant polypeptide generally exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding form of a wild-type or unmodified protein (e.g. an IgSF family member), such as a mature sequence thereof (lacking the signal sequence) or a portion thereof containing the extracellular domain or an IgSF domain thereof. Non-naturally occurring amino acids as well as naturally occurring amino acids are included within the scope of permissible substitutions or additions. A variant protein is not limited to any particular method of making and includes, for example, chemical synthesis, recombinant DNA techniques, or combinations thereof. A variant protein, such as a variant IgSF domain, of the invention specifically binds to at least one or more binding partners. In some embodiments, the altered amino acid sequence results in an altered (i.e., increased or decreased) binding activity, such as binding affinity or avidity, to the one or more binding partners.

The term "wild-type" or "natural" or "native," which are used interchangeably, as used herein is used in connection with biological materials such as nucleic acid molecules, proteins, IgSF members, host cells, and the like, refers to those which are found in nature and not modified by human intervention

I. MULTI-DOMAIN IMMUNOMODULATORY PROTEINS

Provided herein are multi-domain immunomodulatory proteins that contain one or more inhibitory receptor binding molecule (IRBM) that binds to an inhibitory receptor and one or more activating receptor binding molecule (ARBM) that binds to an activating receptor or a ligand of an activating receptor. In some embodiments, the activating receptor comprises an immunoreceptor tyrosine-based activation motif (ITAM) or interacts with an adaptor protein involved in signal transduction pathways in an immune cell, such as a T cell, to transduce activation signals. In some embodiments, the inhibitory receptor comprises an immunoreceptor tyrosine-based inhibitory motif (ITIM). In some embodiments, the inhibitory receptor and the activating receptor are expressed on the same immune cell. In some embodiments, the activating receptor and inhibitory receptor are both expressed on a T cell.

In some embodiments, the provided multi-domain immunomodulatory proteins can be generated in a cis binding strategy to target an inhibitory receptor and activating receptor on the same immune cell, such as the same T cell, which, in some cases, proximalize or cluster the inhibitory receptor and the activating receptor on the surface of the same cell. In such embodiments, the IRBM binds to the inhibitory receptor and the ARBM binds to the activating receptor.

In other embodiments, the provided multi-domain immunomodulatory proteins can be generated in a trans binding strategy to target an inhibitory receptor and a ligand of an activating receptor, each present on different immune cells in an immune synapse. For example, in some embodiments, the IRBM binds to the inhibitory receptor on a T cell and the ARBM binds to a ligand of the activating receptor on an antigen-presenting cell (APC). In the trans strategy, localization of the ligand on the APC during immune synapse formation may be sufficient for signaling by its cognate activating receptor, such that the presence of the immunomodulatory protein could antagonize such as a signal and instead present an inhibitory ligand to recruit the inhibitory receptor to the immune synapse.

In some embodiments, the ARBM can be any binding molecule that binds to an activating receptor or a ligand thereof. In some embodiments, the IRBM can be any binding molecule that binds to an inhibitory receptor. In some embodiments, the one or more IRBM and/or ARBM independently include an antibody or an antigen-binding antibody fragment. In some aspects, the IRBM and/or ARBM can be a human antibody and/or an antibody that binds a human protein.

In some embodiments, at least one of the IRBM or ARBM is not an antibody or antigen-binding fragment. In some embodiments, at least one of the IRBM or ARBM is or contains a non-antibody immunoglobulin superfamily (IgSF) domain (IgD) of an IgSF member, or is a specific binding fragment of such an IgSF domain. In some embodiments, the at least one of the IRBM or ARBM can be a variant IgD (hereinafter called "vIgD") in which is contained one or more amino acid modifications (e.g. substitutions) in an IgD. In some aspects, the vIgD is an affinity-modified domain that exhibits increased binding activity, such as increased binding affinity, for the activating receptor (or ligand of the activating receptor) or inhibitory receptor compared to the binding activity of the unmodified or wild-type IgD for the same molecule. In some embodiment, both the IRBM and ARBM contain one or more IgD or vIgD of an IgSF member, in which, typically, the IgD or vIgD of the IRBM and ARBM are from, or derived from, a different IgSF member.

In some embodiments, the multi-domain immunomodulatory protein provided herein are soluble proteins and/or do not contain a portion that includes a transmembrane domain. Those of skill will appreciate that cell surface proteins, including proteins of the IgSF, typically have an intracellular domain, a transmembrane domain, and extracellular domain (ECD), and that a soluble form of such proteins can be made using the extracellular domain or an immunologically active subsequence thereof. Thus, in some embodiments, the ARBM or IRBM lacks a transmembrane domain or a portion of the transmembrane domain of an IgSF member. In some embodiments, the ARBM or IRBM lacks the intracellular (cytoplasmic) domain or a portion of the intracellular domain of an IgSF member. In some embodiments, the ARBM or IRBM only contains the ECD domain or a portion thereof containing an IgSF domain, such an IgV domain, or specific binding fragments thereof. In some cases, the ARBM and IRBM independently can include the extracellular domain of an IgSF family member or an IgSF domain or specific binding fragment thereof of an IgSF family member. In some aspects, the IgSF domain is an IgV domain or an IgC domain. In some aspects, the IgSF domain is an IgV domain or an IgC domain. In some aspects, the IRBM and/or ARBM is an IgSF domain of a IgSF family member that is a human protein and/or binds a human protein.

In some embodiments, the ARBM can bind to an activating receptor with at least a certain binding activity, such as binding affinity, as measured by any of a number of known methods. In some embodiments, the IRBM can bind to an inhibitory receptor with at least a certain binding activity, such as binding affinity, as measured by any of a number of known methods. In some embodiments, the affinity is represented by an equilibrium dissociation constant ($K_D$) or is represented by $EC_{50}$. A variety of assays are known for assessing binding activity, including binding affinity, and/or determining whether a binding molecule (e.g., an ARBM or IRBM) specifically binds to a particular binding partner. In some embodiments, a BIAcore® instrument can be used to determine the binding kinetics and constants of a complex between two proteins using surface plasmon resonance (SPR) analysis (see, e.g., Scatchard et al., *Ann. N.Y. Acad. Sci.* 51:660, 1949; Wilson, *Science* 295:2103, 2002; Wolff et al., *Cancer Res.* 53:2560, 1993; and U.S. Pat. Nos. 5,283,173, 5,468,614, or the equivalent). Other suitable assays for measuring the binding of one protein to another include, for example, immunoassays such as enzyme linked immunosorbent assays (ELISA) and radioimmunoassays (RIA), or determination of binding by monitoring the change in the spectroscopic or optical properties of the proteins through fluorescence, UV absorption, circular dichroism, or nuclear magnetic resonance (NMR). Other exemplary assays include, but are not limited to, Western blot, ELISA, analytical ultracentrifugation, spectroscopy, flow cytometry, sequencing and other methods for detection of expressed nucleic acids or binding of proteins.

In some embodiments, the ARBM and IRBM independently exhibit a binding affinity for a binding partner with a $K_D$ (i.e., an equilibrium dissociation constant of a particular binding interaction with units of M; equal to the ratio of the off-rate [$k_{off}$ or $k_d$] to the on-rate [$k_{on}$ or $k_a$] for this association reaction, assuming bimolecular interaction) of equal to or less than $10^{-5}$ M. For example, the equilibrium dissociation constant $K_D$ ranges from $10^{-6}$ M to $10^{-12}$ M, such as $10^{-7}$ M to $10^{-11}$ M, $10^{-8}$ M to $10^{-10}$ M, or $10^{-9}$ M to $10^{-10}$ M. The on-rate (association rate constant; $k_{on}$ or $k_a$; units of 1/Ms) and the off-rate (dissociation rate constant; $k_{off}$ or $k_d$; units of 1/s) can be determined using any of the assay methods known in the art, for example, surface plasmon resonance (SPR).

In some embodiments, the IRBM exhibits a binding affinity for an inhibitory receptor that is from or from about 0.001 nM to 1000 nM, such as from or from about 0.01 nM to about 500 nM, from or from about 0.01 nM to about 400 nM, from or from about 0.01 nM to about 100 nM, from or from about 0.01 nM to about 50 nM, from or from about 0.01 nM to about 10 nM, from or from about 0.01 nM to about 1 nM, from or from about 0.01 nM to about 0.1 nM, is from or from about 0.1 nM to about 500 nM, from or from about 0.1 nM to about 400 nM, from or from about 0.1 nM to about 100 nM, from or from about 0.1 nM to about 50 nM, from or from about 0.1 nM to about 10 nM, from or from about 0.1 nM to about 1 nM, from or from about 0.5 nM to about 200 nM, from or from about 1 nM to about 500 nM, from or from about 1 nM to about 100 nM, from or from about 1 nM to about 50 nM, from or from about 1 nM to about 10 nM, from or from about 2 nM to about 50 nM, from or from about 10 nM to about 500 nM, from or from about 10 nM to about 100 nM, from or from about 10 nM to about 50 nM, from or from about 50 nM to about 500 nM, from or from about 50 nM to about 100 nM or from or from about 100 nM to about 500 nM. In certain embodiments, the binding affinity of the IRBM for the inhibitory receptor is at or less than or about 400 nM, 300 nM, 200 nM, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM or less.

In some embodiments, the ARBM exhibits a binding affinity for an activating receptor or a ligand of an activating receptor that is from or from about 0.001 nM to about 1000 nM, such as from or from about 0.01 nM to about 500 nM, from or from about 0.01 nM to about 400 nM, from or from about 0.01 nM to about 100 nM, from or from about 0.01 nM to about 50 nM, from or from about 0.01 nM to about 10 nM, from or from about 0.01 nM to about 1 nM, from or from about 0.01 nM to about 0.1 nM, is from or from about 0.1 nM to about 500 nM, from or from about 0.1 nM to about 400 nM, from or from about 0.1 nM to about 100 nM, from or from about 0.1 nM to about 50 nM, from or from about 0.1 nM to about 10 nM, from or from about 0.1 nM to about 1 nM, from or from about 0.5 nM to about 200 nM, from or from about 1 nM to about 500 nM, from or from about 1 nM to about 100 nM, from or from about 1 nM to about 50 nM, from or from about 1 nM to about 10 nM, from or from about 2 nM to about 50 nM, from or from about 10 nM to about 500 nM, from or from about 10 nM to about 100 nM, from or from about 10 nM to about 50 nM, from or from about 50 nM to about 500 nM, from or from about 50 nM to about 100 nM or from or from about 100 nM to about 500 nM. In certain embodiments, the binding affinity of the ARBM for the activating receptor or a ligand of the activating receptor is at or less than or about 400 nM, 300 nM, 200 nM, 100 nM, 50 nM, 40 nM, 30 nM, 25 nM, 20 nM, 19 nM, 18 nM, 17 nM, 16 nM, 15 nM, 14 nM, 13 nM, 12 nM, 11 nM, 10 nM, 9 nM, 8 nM, 7 nM, 6 nM, 5 nM, 4 nM, 3 nM, 2 nM, or 1 nM or less.

In some embodiments, the IRBM exhibits higher affinity for the inhibitory receptor than the ARBM exhibits for the activating receptor or a ligand of the activating receptor. For example, in some embodiments, the IRBM exhibits 1.2-fold, 1.5-fold, 2.0-fold, 2.5-fold, 3.0-fold, 4.0-fold, 5.0-fold, 6.0-fold, 7.0-fold, 8.0-fold, 9.0-fold, 10.0 fold or higher affinity for the inhibitory receptor than the ARBM exhibits for the activating receptor or a ligand of the activating receptor.

In some embodiments, the provided multi-domain immunomodulatory proteins can include the ARBM and IRBM in various configurations or formats, including formats with one or more further moieties. In some embodiments, the provided immunomodulatory proteins include polypeptides in which the one or more IRBM is N-terminal to the ARBM. In some embodiments, the one or more IRBM is C-terminal to the ARBM. The one or more ARBM and the one or more IRBM can be linked directly or indirectly, via a linker. In some embodiments, the immunomodulatory proteins can be formatted as multimeric molecules via fusion with a multimerization domain, such as an Fc protein. In some embodiments, the multi-domain immunomodulatory proteins can be formatted as multimeric molecules, e.g., dimeric, trimer, tetrameric, or pentameric molecules. In some embodiments, the immunomodulatory proteins are formatted as a monomeric molecules containing single polypeptide fusions of the one or more ARBM and the one or more IRBM. In some aspects, the configurations can be chosen to effect spatial proximalization of ITIM bearing inhibitory receptors with activating receptors on immune cells, such as T cells, to make possible attenuation of T cell activation and/or tolerance induction.

In the subsections below, exemplary ARBM and IRBM components of the provided multi-domain immunomodulatory protein are described, as are exemplary formats for such immunomodulatory proteins.

A. Inhibitory Receptor Binding Molecule (IRBM)

In some embodiments, the provided immunomodulatory polypeptides contain an IRBM that binds to an inhibitory receptor. In some aspects, the inhibitory receptor includes an immunoreceptor tyrosine-based inhibitory motif (ITIM). In some embodiments, the inhibitory receptor target of the IRBM is CTLA-4, PD-1, or TIGIT, including any mammalian orthologs thereof. In some embodiments, the inhibitory receptor target is a human CTLA-4, human PD-1 or human TIGIT. In some embodiments, the inhibitory receptor is expressed on a T cell, such as a human T cell.

In some embodiments, the IRBM is an antibody or antigen-binding fragment that binds an inhibitory receptor. In some embodiments, the IRBM is an antibody or antigen-binding fragment that binds CTLA-4, PD-1 or TIGIT, such as a human CTLA-4, human PD-1 or human TIGIT.

In some embodiments, the IRBM is or contains a binding partner of an inhibitory receptor. For example, in some aspects, the IRBM is or contains an IgD of an IgSF family member that binds to an inhibitory receptor, such as a PD-1, TIGIT or CTLA-4 inhibitory receptor, or is a specific fragment or vIgD thereof that binds to the inhibitory receptor. Exemplary IgSF family members that are binding partners of or that bind to a PD-1 inhibitory receptor include, for example, PD-L1 and PD-L2, such as human PD-L1 or human PD-L2. Exemplary IgSF family members that are binding partners of or that bind to a TIGIT inhibitory receptor include, for example, CD155 or CD112, such as human CD155 or human CD112. In some embodiments, the IgSF binding partner of an inhibitory receptor is a molecule set forth in Table 1. In some examples, the IRBM is or contains an IgD of a wild-type PD-L1 or PD-L2 or is or contains a vIgD thereof, wherein the IRBM specifically binds to PD-1. In other examples, the IRBM is or contains an IgD of CD155 or CD112 or is or contains a vIgD thereof, wherein the IRBM specifically binds to TIGIT.

The first column of Table 1 provides the name and, optionally, the name of some possible synonyms for that particular domain. The second column provides the protein identifier of the UniProtKB database, a publicly available database accessible via the internet at uniprot.org. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). The third column provides the region where the indicated IgSF domain is located. The region is specified as a range where the domain is inclusive of the residues defining the range. Column 3 also indicates the domain class for the specified region. Column 4 provides the region where the indicated additional domains are located (signal peptide, S; extracellular domain, E; transmembrane domain, T; cytoplasmic domain, C). Column 5 indicates for some of the listed IgSF members, some of its cognate cell surface binding partners. It is understood that reference to amino acids, including to a specific sequence set forth as a SEQ ID NO used to describe domain organization, such as of an IgSF domain, are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three, four, five, six or more amino acids) longer or shorter.

TABLE 1

Exemplary IgSF as Inhibitory Receptor Binding Molecules (IRBM)

| Receptor-binding Domains (Synonyms) | NCBI Protein Accession Number/UniProtKB Protein Identifier | Region & Domain Class | Other Domains | Cognate Cell Surface Binding Partners | IgSF Member Amino Acid Sequence (SEQ ID NO): Precursor (mature residues) | Mature | ECD |
|---|---|---|---|---|---|---|---|
| CD274 (PD-L1, B7-H1) | Q9NZQ7.1 | 24-130 IgV, 133-225 IgC2 | S: 1-18, E: 19-238, T: 239-259, C: 260-290 | PD-1, B7-1 | SEQ ID NO: 3 (19-290) | SEQ ID NO: 383 | SEQ ID NO: 30 |
| PDCD1LG2 (PD-L2, CD273) | Q9BQ51.2 | 21-118 IgV, 122-203 IgC2 | S: 1-19, E: 20-220, T: 221-241, C: 242-273 | PD-1, RGMb | SEQ ID NO: 4 (20-273) | SEQ ID NO: 384 | SEQ ID NO: 31 |
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | SEQ ID NO: 20 (21-417) | SEQ ID NO: 208 | SEQ ID NO: 47 |
| PVRL2 (CD112) | Q92692.1 | 32-156 IgV, 162-256 IgC2, 261-345 IgC2 | S: 1-31, E: 32-360, T: 361-381, C: 382-538 | TIGIT, CD226, CD112R | SEQ ID NO: 21 (32-538) | SEQ ID NO: 209 | SEQ ID NO: 48 |

In some embodiments, the IRBM is or contains a wild-type or unmodified IgD of a binding partner of an inhibitory receptor, such as a sequence that is or contains an ECD or an IgD domain or domains of a native binding partner of an inhibitory receptor or an ortholog thereof. In some embodiments, the IRBM is or comprises the extracellular domain (ECD), or a portion thereof containing one or more IgSF domains, of an IgSF member set forth in Table 1, e.g. human PD-L1, human PD-L2, human CD155 or human CD112. In some embodiments, the extracellular domain comprises an IgV domain or domains and, in some cases, an IgC (e.g. IgC1 and/or IgC2) domain or domains. In some embodiments, the IRBM is less than the full length sequence of the IgSF binding partner of the inhibitory receptor. For example, in some aspects, the IRBM is or only contains the extracellular domain (ECD) or specific binding fragment thereof of the binding partner. In some embodiments, the IRBM is or only contains the IgV domain or the IgC domain or specific binding fragment of the IgV domain or the IgC domain, or combinations thereof. In some embodiments, the IRBM can be an IgV only, the combination of the IgV and IgC, including the entire extracellular domain (ECD), or any combination of Ig domains. In some embodiments, the IRBM consists or consists essentially of the ECD or an IgD domain or domain thereof of a binding partner of an inhibitory receptor, such as consists or consists essentially of the ECD, IgV or IgC domain or domains. In some embodiments, the sequence of the IRBM containing an IgD of a binding partner of an inhibitory receptor is a mammalian sequence that includes, but is not limited to, human, mouse, cynomolgus monkey, or rat. In some embodiments, the sequence of IRBM containing an IgD is human. Table 1 provides exemplary residues that correspond to ECD, IgV, or IgC regions of various IgSF domains of binding partners of exemplary inhibitory receptors.

In some embodiments, the IRBM is or contains a vIgD that contains one or more amino acids modifications, such as one or more substitutions (alternatively, "mutations" or "replacements"), deletions or additions, in an IgD relative to a wild-type or unmodified IgD of a binding partner of the inhibitory receptor. In some aspects, the vIgD contains up to 1, 2, 3, 4, 5, 6, 7, 8, 9, 10, 11, 12, 13, 14, 15, 16, 17, 18, 19 or 20 amino acid modifications, such as amino acid substitutions, deletions or additions in an IgD domain of an IgSF binding partner of an inhibitory receptor, e.g. in an IgD domain of a binding partner set forth in Table 1. The modifications (e.g., substitutions) can be in the IgV domain or the IgC domain. In some embodiments, the vIgD has up to 1, 2, 3, 4, 5, 6, 7, 8, 9, 10, 11, 12, 13, 14, 15, 16, 17, 18, 19, or 20 amino acid modifications (e.g., substitutions) in the IgV domain or specific binding fragment thereof. In some embodiments, the vIgD has up to 1, 2, 3, 4, 5, 6, 7, 8, 9, 10, 11, 12, 13, 14, 15, 16, 17, 18, 19, or 20 amino acid modifications (e.g., substitutions) in the IgC domain or specific binding fragment thereof. In some embodiments, the vIgD has at least about 85%, 86%, 86%, 88%, 89%, 90%, 91%, 92%, 93%, 94%, 95%, 96%, 97%, 98%, or 99% sequence identity with the wild-type or unmodified IgD or specific binding fragment thereof.

In some embodiments, the IRBM is a variant of a binding partner of an inhibitory receptor (e.g. variant of a molecule set forth in Table 1, e.g. human PD-L1, human PD-L2, human CD155 or human CD112), in which the IRBM is or comprises an ECD, or portion thereof, containing one or more vIgD of an IgSF binding partner of an inhibitory receptor. In some embodiments, the IRBM can comprise an IgV domain or an IgC domain or domains, or a specific binding fragment of the IgV domain or a specific binding fragment of the IgC domain or domains in which one or more of the IgSF domains (IgV or IgC) contains the one or more amino acid modifications (e.g. substitutions). In some embodiments, the IRBM can comprise an IgV domain and an IgC domain or domains, or a specific binding fragment of the IgV domain and a specific binding fragment of the IgC domain or domains, in which at least one of the IgV or IgC domain contains the amino acid modifications (e.g. substitutions). In some embodiments, the IRBM consists or consists essentially of the ECD containing a vIgD (e.g. IgV and/or IgC). In some embodiments, the IRBM contains only, such as consists or consists essentially of, an IgV domain or a specific binding fragment of the IgV domain, in which the one or more amino acid modifications (e.g. substitutions) are located in the IgV domain or specific binding fragment of the IgV domain. In some embodiments, the IRBM contains only, such as consists or consists essentially of, an IgC domain or a specific binding fragment of the IgC domain, in which the one or more amino acid modifications (e.g. substitutions) are located in an IgC domain or specific binding fragment of an IgC domain.

In some embodiments, the one or more amino acid modifications alter, such as increase, the binding activity, e.g. binding affinity, of the extracellular domain of the binding partner or an IgD domain thereof (e.g. IgV) for its cognate inhibitory receptor. In some embodiments, by virtue of the altered binding activity, such as binding affinity, the vIgD domain is an affinity-modified IgSF domain. Typically, the affinity-modified IgSF domain used in or as the IRBM is a human or murine affinity modified IgSF domain.

In some embodiments, an IRBM containing a vIgD has a binding activity, such as binding affinity, for the inhibitory receptor that is altered, e.g. increased, from that of an IRBM containing a wild-type or unmodified IgD sequence as determined by, for example, solid-phase ELISA immunoassays, flow cytometry or surface plasmon resonance (Biacore) assays. In some embodiments, the vIgD results in an increased binding activity, such as binding affinity, for the inhibitory receptor, relative to a wild-type or unmodified IgD. In some embodiments, the increase in binding activity, such as binding affinity, for the inhibitory receptor is at least about 5%, such as at least about 10%, 15%, 20%, 25%, 35%, 40%, 50%, 60%, 70%, 90%, 100%, 200% or more. In some embodiments, the increase in binding activity, such as binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified IgD has the same sequence as the vIgD except that it does not contain the one or more amino acid modifications (e.g. substitutions). In some embodiments, the equilibrium dissociation constant ($K_d$) of the IRBM to the inhibitory receptor can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less.

The use of the term "modification", such as "substitution" does not imply that the present embodiments are limited to a particular method of making the immunomodulatory proteins. An IRBM that is or contains IgD or vIgDs can be made, for example, by de novo peptide synthesis and thus does not necessarily require a modification, such as a "substitution" in the sense of altering a codon to encode for the modification, e.g. substitution. This principle also extends to the terms "addition" and "deletion" of an amino acid residue which likewise do not imply a particular method of making. The means by which the vIgDs are designed or created is not limited to any particular method. In some embodiments, however, a wild-type or unmodified IgD encoding nucleic acid is mutagenized from wild-type or unmodified IgD genetic material and screened for desired specific binding activity, such as binding affinity, and/or alteration of IFN-gamma expression or other functional activity. In some embodiments, a vIgD is synthesized de novo utilizing protein or nucleic acid sequences available at any number of publicly available databases and then subsequently screened. The National Center for Biotechnology Information provides such information and its website is publicly accessible via the internet as is the UniProtKB database.

In some embodiments, the IRBM has (i) the sequence of amino acids set forth in SEQ ID NO: 3, 4, 20, 21 or a mature form thereof lacking the signal sequence, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 3, 4, 20 or 21 or the mature form thereof, or (iii) a portion of (i) or (ii) containing the extracellular domain or an IgV domain or IgC domain or specific binding fragments thereof. In some embodiments, the IRBM has (i) the sequence of amino acids (i) set forth in SEQ ID NO: 208, 209, 383 or 384, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 208, 209, 383 or 384; or (iii) a portion of (i) or (ii) containing the extracellular domain or an IgV domain or IgC domain or specific binding fragment thereof.

In some embodiments, the IRBM is or comprises an extracellular domain or a portion thereof of an IgSF member that is a binding partner of an inhibitory receptor (e.g. Table 1). In some embodiments, the IRBM has or comprises the amino acid sequence set forth in SEQ ID NO: 30, 31, 47, 48, or an ortholog thereof. In some cases, the IRBM has or comprises (i) the sequence of amino acids set forth in SEQ ID NO: 30, 31, 47, 48, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 30, 31, 47, 48, or (iii) is a specific binding fragment of the sequence of (i) or (ii) comprising an IgV domain or an IgC domain.

In some embodiments, the IRBM is or comprises an IgV domain or an IgC domain or domains, or a specific binding fragment thereof. In some embodiments, the IRBM has or comprises the amino acid sequence set forth in SEQ ID NO: 55, 309, 310, 353, 666, 761, 1203, 1263, or an ortholog thereof. For example, the IRBM has or comprises (i) the sequence of amino acids set forth in SEQ ID NO: 55, 309, 310, 353, 666, 761, 1203 or 1263, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 55, 309, 310, 353, 666, 761, 1203 or 1263, or (iii) a specific binding fragment of the sequence of (i) or (ii).

1. PD-1 Binding Molecule

Provided are immunomodulatory proteins containing an IRBM that is or contains a binding molecule that binds to PD-1, such as to human PD-1. Programmed death 1 (PD-1) receptor or PD-1 is expressed on NK cells and T cells, including CD4+ and CD8+ T cells, whereby engagement of PD-1 can inhibit activation cell activation, proliferation, and/or expansion. In some embodiments, the IRBM of the immunomodulatory protein binds to the ectodomain of PD-1. In some embodiments, the IRBM binds to PD-1 on the surface of a cell, such as on the surface of a T cell.

In some embodiments, the provided immunomodulatory protein contains an IRBM that is or contains an antibody that binds PD-1 or is an antigen-binding antibody fragment thereof (e.g. Fab or scFv). In some embodiments, the antibody or antigen-binding antibody fragment binds human PD-1. For example, in some embodiments, the antibody is nivolumab, pembrolizumab, pidilizumab or BMS-936559 or an antigen binding fragment containing a VH chain region and/or VL chain region of nivolumab, pembrolizumab, pidilizumab or BMS-936559. In some embodiments, the antibody is a single chain variable fragment (e.g. scFv) containing a VH and VL of nivolumab, pembrolizumab, pidilizumab or BMS-936559.

In some embodiments, the IRBM is or contains one or more IgD (e.g. IgV or IgC) or a specific binding fragment thereof, such as an unmodified or wild-type IgD or a vIgD or a specific binding fragment thereof, of an IgSF family member that binds PD-1. In some embodiments, the PD-1 is human PD-1. PD-1 is the T-cell costimulatory receptor for the ligands PD-L1 (also known as cluster of differentiation 274, CD274. B7 homolog 1 or B7-H1) and PD-L2 (also known as PDCD1L2, PDCD1LG2, cluster of differentiation 273, CD273. or B7-DC). PD-L1 and PD-L2 are normally expressed on the surface of T cells, B cells, and myeloid cells. PD-L1 and PD-L2 are negative regulators of immune activation and are capable of down-modulating the immune response via interactions with PD-1.

In some embodiment, the IRBM is or contains one or more IgD (e.g. IgV or IgC) that is an IgD of PD-L1 or PD-L2 polypeptide, such as a wild-type PD-L1 or PD-L2, e.g. a human PD-L1 or human PD-L2. In some aspects, the IRBM contains one or more IgD (e.g. IgV or IgC) that is an vIgD containing one or more amino acid modifications (e.g., substitutions, deletions or additions) compared to an IgD of a wild-type or unmodified PD-L1 or PD-L2, which, in some aspects, result in increased binding of the IRBM to PD-1. Exemplary IgDs or vIgDs of PD-L1 or PD-L2 binding partners for inclusion as an IRBM in the provided immunomodulatory proteins are described. In some embodiments, the IRBM is or contains a vIgD polypeptide that exhibit increased binding activity, such as binding affinity, for PD-1 compared to a corresponding wild-type or unmodified IgD.

a. PD-L1 IgD or vIgD

Provided herein are immunomodulatory proteins containing an IRBM that is or contains one or more IgD, such as an unmodified or wild-type IgD or a vIgD, of PD-L1. In some embodiments, the IRBM is or contains one or more IgD domain of a wild-type or unmodified PD-L1, such as a mammalian PD-L1, e.g. a human PD-L1. In some embodiments, the IRBM is not the full length sequence of the PD-L1. In some aspects, the IRBM is a soluble polypeptide, is not membrane-expressed and/or lacks the transmembrane and/or cytoplasmic domain of PD-L1. In some embodiments, the IRBM only contains an extracellular domain (ECD) or a specific binding fragment thereof containing a IgD or vIgD, such as only contains an IgV domain or an IgC domain or specific binding fragment thereof, or combinations thereof.

In some embodiments, the IRBM is or contains the ECD sequence set forth in SEQ ID NO:30 or 1728 or is a specific binding fragment thereof. In some embodiments, the IRBM is or contains the IgV sequence set forth in SEQ ID NO: 309 (containing residues 1-114 of SEQ ID NO:30) or set forth in SEQ ID NO:55, or is a specific binding fragment thereof.

```
                                        (SEQ ID NO: 30)
FTVTVPKDLYVVEYGSNMTIECKFPVEKQLDLAALIVYWEMEDKNIIQFV

HGEEDLKVQHSSYRQRARLLKDQLSLGNAALQITDVKLQDAGVYRCMISY

GGADYKRITVKVNAPYNKINQRILVVDPVTSEHELTCQAEGYPKAEVIWT

SSDHQVLSGKTTTTNSKREEKLFNVTSTLRINTTTNEIFYCTFRRLDPEE

NHTAELVIPELPLAHPPNER

                                      (SEQ ID NO: 1728)
FTVTVPKDLYVVEYGSNMTIECKFPVEKQLDLAALIVYWEMEDKNIIQFV

HGEEDLKVQHSSYRQRARLLKDQLSLGNAALQITDVKLQDAGVYRCMISY

GGADYKRITVKVNAPYNKINQRILVVDPVTSEHELTCQAEGYPKAEVIWT

SSDHQVLSGKTTTTNSKREEKLFNVTSTLRINTTTNEIFYCTFRRLDPEE

NHTAELVIPELPLAHPPNERT
```

-continued

```
                                       (SEQ ID NO: 309)
FTVTVPKDLYVVEYGSNMTIECKFPVEKQLDLAALIVYWEMEDKNIIQFV

HGEEDLKVQHSSYRQRARLLKDQLSLGNAALQITDVKLQDAGVYRCMISY

GGADYKRITVKVNA

                                        (SEQ ID NO: 55)
PKDLYVVEYGSNMTIECKFPVEKQLDLAALIVYWEMEDKNIIQFVHGEED

LKVQHSSYRQRARLLKDQLSLGNAALQITDVKLQDAGVYRCMISYGGADY

KRITVKV
```

In some embodiments, the immunomodulatory protein contains an IRBM that is or contains a vIgD containing one or more amino acid modifications, e.g. substitutions, in an IgD of a wild-type or unmodified PD-L1. In some embodiments, modifications provided herein can be in an IRBM containing an unmodified IgD set forth in SEQ ID NO:30, 55, 309 or 1728 or in a sequence that has 85%, 85%, 87%, 88%, 89%, 90%, 91%, 92%, 93%, 94%, 95%, 96%, 97%, 98%, 99% or more sequence identity to SEQ ID NO: 30, 55, 309 or 1728. In some embodiments, an IRBM containing a vIgD of PD-L1 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 30, 1728, 55 or 309.

In some embodiments, the vIgD is an affinity-modified IgSF domain that has an increased binding activity, such as binding affinity, for PD-1 relative to the binding activity of the wild-type or unmodified IgD for PD-1. In some embodiments, the increase in binding activity, e.g. binding affinity, for PD-1 is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions). In some embodiments, the equilibrium dissociation constant ($K_d$) of the IRBM to PD-1 can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$M or less.

Unless stated otherwise, the amino acid modification(s) present in a vIgD of a PD-L1 ECD or an IgD (e.g. IgV) thereof are designated by amino acid position number corresponding to the numbering of positions of the unmodified ECD sequence set forth in SEQ ID NO:30 or 1728 or, where applicable, the unmodified IgV sequence set forth in SEQ ID NO: 309 (containing residues 1-114, respectively, of SEQ ID NO:30). It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs: 30, 309 or 1728. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a “del” is indicated and if the modification is an insertion at the position an “ins” is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the IRBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified PD-L1. In some embodiments, the one or more amino acid modifications, e.g. substitutions, are in the ECD domain of PD-L1 or a specific binding fragment thereof. In some embodiments, the one or more amino acid modifications, e.g. substitutions, are in the IgV domain of PD-L1 or a specific binding fragment thereof. In some embodiments, the one or more amino acid modifications, e.g. substitutions, are in an IgC domain of PD-L1 or a specific binding fragment thereof. In some embodiments, the one or more amino acid modifications, e.g. substitutions, are in the IgV domain of PD-L1 or a specific binding fragment thereof and in an IgC domain or domains of PD-L1 or a specific binding fragment thereof.

In some embodiments, the IRBM is or contains a vIgD that has one or more amino acid modifications, e.g. substitutions, in an unmodified IgD of PD-L1 or a specific binding fragment thereof corresponding to position(s) 6, 10, 11, 14, 15, 16, 17, 18, 19, 20, 22, 23, 26, 27, 28, 33, 35, 36, 40, 41, 43, 44, 45, 46, 47, 49, 50, 51, 52, 53, 54, 55, 56, 57, 58, 60, 64, 65, 68, 71, 72, 73, 74, 75, 78, 79, 83, 85, 89, 90, 93, 97, 98, 99, 101, 102, 103, 104, 106, 110, 111, 112, 113, 117, 119, 120, 121, 124, 129, 130, 131, 134, 137, 138, 144, 148, 149, 150, 155, 158, 160, 163, 165, 167, 170, 171, 173, 175, 176, 177, 179, 180, 183, 185, 188, 189, 192, 193, 194, 195, 196, 197, 198, 199, 200, 201, 202, 203, 204, 206, 207, 213, or 221, with reference to positions set forth in SEQ ID NO: 30 or 1728. In some embodiments, a polypeptide containing the vIgD exhibits altered, such as increased, binding activity, e.g. binding affinity, to PD-1 compared to a polypeptide containing the wild-type or unmodified PD-L1 IgD.

In some embodiments, the IRBM is or contains a vIgD of PD-L1 that has one or more amino acid modification selected from P6S, Y10F, V11A, V11E, Y14S, G15A, S16G, N17D, M18I, M18T, M18V, T19A, T19I, I20L, C22R, K23E, K23N, K23R, E26A, E27D, E27G, K28E, K28I, K28N, K28R, A33D, L35P, I36S, I36T, E40G, M41K, M41V, D43G, D43V, K44E, N45D, N45I, N45T, I46V, I47T, F49S, V50A, H51N, H51R, H51Y, G52R, G52V, E53G, E53V, E54G, D55G, D55N, D55S, D55V, L56Q, K57E, K57R, V58A, V58D, H60R, R64S, Q65L, R68L, K71E, D72G, Q73R, L74P, S75P, N78I, N78S, A79T, I83T, D85E, Q89R, D90G, V93E, M97I, M97K, M97L, I98L, I98T, I98V, S99G, G101D, G101G-ins (G101GG), G102D, A103V, D104G, K106E, K106R, V110M, K111E, K111T, V112A, N113Y, N117S, 1119T, N120S, Q121L, L124S, V129A, V129D, T130A, S131F, E134G, C137R, Q138R, K144E, K144Q, I148V, W149R, T150A, Q155H, S158G, K160M, T163I, K163N, N165Y, K167R, K167T, E170G, K171R, F173I, F173L, K173Y, V175A, S177C, L179P, R180S, T183A, T183I, T185A, I188V, F189L, F189S, T192S, F193S, R194G, R194W, R195G, R195S, R195T, L196S, D197G, P198S, P198T, E199G, E200K, E200N, N201D, N201Y, H202Q, T203A, A204T, L206F, V207A, L213P, OR T221L or a conservative amino acid substitution thereof.

In some embodiments, the IRBM is or contains a vIgD that has two or more amino acid modifications selected from P6S, Y10F, V11A, V11E, Y14S, G15A, S16G, N17D, M18I, M18T, M18V, T19A, T19I, I20L, C22R, K23E, K23N, K23R, E26A, E27D, E27G, K28E, K28I, K28N, K28R, A33D, L35P, I36S, I36T, E40G, M41K, M41V, D43G, D43V, K44E, N45D, N45I, N45T, I46V, I47T, F49S, V50A, H51N, H51R, H51Y, G52R, G52V, E53G, E53V, E54G, D55G, D55N, D55S, D55V, L56Q, K57E, K57R, V58A, V58D, H60R, R64S, Q65L, R68L, K71E, D72G, Q73R, L74P, S75P, N78I, N78S, A79T, I83T, D85E, Q89R, D90G, V93E, M97I, M97K, M97L, I98L, I98T, I98V, S99G, G101D, G101G-ins (G101GG), G102D, A103V, D104G, K106E, K106R, V110M, K111E, K111T, V112A, N113Y, N117S, 1119T, N120S, Q121L, L124S, V129A, V129D, T130A, S131F, E134G, C137R, Q138R, K144E, K144Q, I148V, W149R, T150A, Q155H, S158G, K160M, T163I, K163N, N165Y, K167R, K167T, E170G, K171R, F173I, F173L, K173Y, V175A, S177C, L179P, R180S, T183A, T183I, T185A, I188V, F189L, F189S, T192S, F193S, R194G, R194W, R195G, R195S, R195T, L196S, D197G, P198S, P198T, E199G, E200K, E200N, N201D, N201Y, H202Q, T203A, A204T, L206F, V207A, L213P, or T221L.

In some embodiments, the modification(s), e.g. substitutions(s), can be K28N/M41V/N45T/H51N/K57E, I20L/I36T/N45D/I47T, I20L/M41K/K44E, P6S/N45T/N78I/I83T, N78I, M41K/N78I, N45T/N78I, I20L/N45T, N45T, M41K, I20L/I36T/N45D, N17D/N45T/V50A/D72G, I20L/F49S, N45T/V50A, I20L/N45T/N78I, I20L/N45T/V50A, M41V/N45T, M41K/N45T, A33D/S75P/D85E, M18I/M41K/D43G/H51R/N78I, V11E/I20L/I36T/N45D/H60R/S75P, A33D/V50A, S16G/A33D/K71E/S75P, E27G/N45T/M97I, E27G/N45T/K57R, A33D/E53V, D43G/N45D/V58A, E40G/D43V/N45T/V50A, Y14S/K28E/N45T A33D/N78S, A33D/N78I, A33D/N45T, A33D/N45T/N78I, E27G/N45T/V50A, N45T/V50A/N78S, I20L/N45TN110M, I20L/I36T/N45T/V50A, N45T/L74P/S75P, N45T/S75P, S75P/K106R, S75P, A33D/S75P, A33D/S75P/D104G, A33D/S75P, I20L/E27G/N45T/V50A, I20L/E27G/D43G/N45D/V58A/N78I, I20L/D43G/N45D/V58A/N78I, I20L/A33D/D43G/N45D/V58A/N78I, I20L/D43G/N45D/N78I, E27G/N45T/V50A/N78I, N45T/V50A/N78I, V11A/I20L/E27G/D43G/N45D/H51Y/S99G, I20L/E27G/D43G/N45T/V50A, I20L/K28E/D43G/N45D/V58A/Q89R, I20L/I36T/N45D, I20L/K28E/D43G/N45D/E53G/V58A/N78I, A33D/D43G/N45D/V58A/S75P, K23R/D43G/N45D, I20L/D43G/N45D/V58A/N78I/D90G/G101D, D43G/N45D/L56Q/V58A/G101GG, I20L/K23E/D43G/N45D/V58A/N78I, I20L/K23E/D43G/N45D/V50A/N78I, T19I/E27G/N45I/V50A/N78I/M97K, I20L/M41K/D43G/N45D, K23R/N45T/N78I, I20L/K28E/D43G/N45D/V58A/Q89R/G101G-ins (G101GG), K57R/S99G, K57R/S99G/F189L, M18V/M97L/F193S/R195G/E200K/H202Q, I36S/M41K/M97L/K144Q/R195G/E200K/H202Q/L206F, C22R/Q65L/L124S/K144Q/R195G/E200N/H202Q/T221L, M18V/I98L/L124S/P198T/L206F, S99G/N117S/I148V/K171R/R180S, I36T/M97L/A103V/Q155H, K28I/S99G, R195S, A79T/S99G/T185A/R195G/E200K/H202Q/L206F, K57R/S99G/L124S/K144Q, K57R/S99G/R195G, D55V/M97L/S99G, E27G/I36T/D55N/M97L/K111E, E54G/M97L/S99G, G15A/I36T/M97L/K111E/H202Q, G15A/I36T/V129D, G15A/I36TN129D/R195G, G15A/V129D, I36S/M97L, I36T/D55N/M97L/K111E/A204T, I36T/D55N/M97L/K111E/V129A/F173L, I36T/D55S/M97L/K111E/I148V/R180S, I36T/G52R/M97L/V112A/K144E/V175A/P198T, I36T/I46V/D55G/M97L/K106E/K144E/T185A/R195G, I36T/I83T/M97L/K144E/P198T, I36T/M97L/K111E, I36T/M97L/K144E/P198T, I36T/M97L/Q155H/F193S/N201Y, I36T/M97L/V129D, L35P/I36S/M97L/K111E, M18I/I36T/E53G/M97L/K144E/E199G/V207A, M18T/I36T/D55N/

M97L/K111E, M18V/M97L/T176N/R195G, M97L/S99G, N17D/M97L/S99G, S99G/T185A/R195G/P198T, V129D/ H202Q, V129D/P198T, V129D/T150A, V93E/V129D, Y10F/M18V/S99G/Q138R/T203A, N45D, K160M/R195G, N45D/K144E, N45D/P198S, N45D/P198T, N45D/R195G, N45D/R195S, N45D/S131F, N45D/V58D, V129D/R195S, I98T/F173Y/L196S, N45D/E134G/L213P, N45D/F173I/ S177C, N45D/I148V/R195G, N45D/K111T/R195G, N45D/ N113Y/R195S, N45D/N165Y/E170G, N45D/Q89R/I98V, N45D/S131F/P198S, N45D/S75P/P198S, N45D/V50A/ R195T, E27D/N45D/T183A/I188V, F173Y/T183I/L196S/ T203A, K23N/N45D/S75P/N120S, N45D/G102D/R194W/ R195G, N45D/G52V/Q121L/P198S, N45D/I148V/R195G/ N201D, N45D/K111T/T183A/I188V, N45D/Q89R/F189S/ P198S, N45D/S99G/C137R/V207A, N45D/T163I/K167R/ R195G, N45D/T183A/T192S/R194G, N45D/V50A/I119T/ K144E, T19A/N45D/K144E/R195G, V11E/N45D/T130A/ P198T, V26A/N45D/T163I/T185A, K23N/N45D/L124S/ K167T/R195G, K23N/N45D/Q73R/T163I, K28E/N45D/ W149R/S158G/P198T, K28R/N45D/K57E/I98V/R195S, K28R/N45D/V129D/T163N/R195T, M41K/D43G/N45D/ R64S/R195G, M41K/D43G/N45D/R64S/S99G, N45D/ R68L/F173L/D197G/P198S, N45D/V50A/I148V/R195G/ N201D, M41K/D43G/K44E/N45D/R195G/N201D, or N45D/V50A/L124S/K144E/L179P/R195G.

In some embodiments, the IRBM contains a vIgD that has one or more amino acid modification, e.g. substitutions, in an unmodified PD-L1 or specific binding fragment thereof corresponding to position(s) 20, 27, 33, 36, 43, 45, 50, 58, 75, 78, 97, 99, 195, and/or 198 with reference to positions set forth in SEQ ID NO:36 or 2655. In some embodiments, the IRBM is or contains a vIgD of PD-L1 that has one or more amino acid modifications selected from I20L, E27D, E27G, A33D, I36S, I36T, D43G, D43V, N45D, N45I, N45T, V50A, V58A, V58D, S75P, N78I, N78S, M97I, M97K, M97L, S99G, R195G, R195S, R195T, P198S, and/or P198T, or a conservative amino acid substitution thereof.

In some embodiments, the IRBM is or contains an IgD (e.g. IgV) of wild-type PD-L1 set forth in Table 2 or a vIgD thereof comprising any of the modifications (e.g. substitutions) listed in Table 2. Table 2 also provides exemplary sequences by reference to SEQ ID NO for IRBMs containing an ECD or IgV domain of PD-L1. As indicated, the exact locus or residues corresponding to a given domain can vary, such as depending on the methods used to identify or classify the domain. Also, in some cases, adjacent N- and/or C-terminal amino acids of a given domain (e.g. ECD or IgV) also can be included in a sequence of an IRBM, such as to ensure proper folding of the domain when expressed. Thus, it is understood that the exemplification of the SEQ ID NOS in Table 2 is not to be construed as limiting. For example, the particular domain, such as the ECD or IgV domain, can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the IRBM is or contains a wild-type PD-L1 ECD set forth in SEQ ID NO:30 or 1728 or a variant ECD sequence set forth in any one of SEQ ID NOS: 56-120, 1725, 1729-1818, 1819-1907, 1943-2008. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the ECD sequences set forth in any one of SEQ ID NOS: 56-120, 1725, 1729-1818, 1819-1907, 1943-2008 and contains the amino acid modification(s), e.g. substitution(s), not present in the wild-type or unmodified PD-L1 ECD, e.g. not present in SEQ ID NO:30 or 1728. In some embodiments, the IRBM is or contains a specific binding fragment of any of the ECD sequences set forth in any one of SEQ ID NOS: 56-120, 1725, 1729-1818, 1819-1907, 1943-2008 and contains the amino acid modification(s), e.g. substitution(s), not present in a wild-type or unmodified PD-L1 ECD, e.g. not present in SEQ ID NO: 30 or 1728.

In some embodiments, the IRBM is or contains a wild-type PD-L1 IgV set forth in SEQ ID NO: 55 or 309 or a variant IgV sequence set forth in any one of SEQ ID NOS: 121-185, 244-308, 1726-1727, 1908-1937. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 121-185, 244-308, 1726-1727, 1908-1937 and contains the amino acid modification(s), e.g. substitution(s), not present in the wild-type or unmodified PD-L1, e.g. not present in SEQ ID NO:55 or 309. In some embodiments, the IRBM is or contains a specific binding fragment of any of the IgV sequences set forth in any one of SEQ ID NOS: 121-185, 244-308, 1726-1727, 1908-1937 and that contains the amino acid modification(s), e.g. substitution(s), not present in a wild-type or unmodified PD-L1 IgV, e.g. not present in SEQ ID NO:55 or 309.

TABLE 2

Exemplary PD-L1 IRBMs containing an IgD or vIgD

| Mutation(s) | ECD SEQ ID NO | IgV SEQ ID NO |
|---|---|---|
| Wild-type | 30, 1728 | 55, 309 |
| K28N/M41V/N45T/H51N/K57E | 56, 1943 | 121, 244 |
| I20L/I36T/N45D/I47T | 57, 1944 | 122, 245 |
| I20L/M41K/K44E | 58, 1945 | 123, 246 |
| P6S/N45T/N78I/I83T | 59, 1946 | 124, 247 |
| N78I | 60, 1947 | 125, 248 |
| M41K/N78I | 61, 1948 | 126, 249 |
| N45T/N78I | 62, 1949 | 127, 250 |
| I20L/N45T | 63, 1950 | 128, 251 |
| N45T | 64, 1951 | 129, 252 |
| M41K | 65, 1952 | 130, 253 |
| I20L/I36T/N45D | 66, 1953 | 131, 254 |
| N17D/N45T/V50A/D72G | 67, 1954 | 132, 255 |
| I20L/F49S | 68, 1955 | 133, 256 |
| N45T/V50A | 69, 1956 | 134, 257 |
| I20L/N45T/N78I | 70, 1957 | 135, 258 |
| I20L/N45T/V50A | 71, 1958 | 136, 259 |
| M41V/N45T | 72, 1959 | 137, 260 |
| M41K/N45T | 73, 1960 | 138, 261 |
| A33D/S75P/D85E | 74, 1961 | 139, 262 |
| M18I/M41K/D43G/H51R/N78I | 75, 1962 | 140, 263 |
| VI1E/I20L/I36T/N45D/H60R/S75P | 76, 1963 | 141, 264 |
| A33D/V50A | 77, 1964 | 142, 265 |
| S16G/A33D/K71E/S75P | 78, 1965 | 143, 266 |
| E27G/N45T/M97I | 79, 1966 | 144, 267 |
| E27G/N45T/K57R | 80, 1967 | 145, 268 |
| A33D/E53V | 81, 1968 | 146, 269 |
| D43G/N45D/V58A | 82, 1969 | 147, 270 |
| E40G/D43V/N45T/V50A | 83, 1970 | 148, 271 |
| Y14S/K28E/N45T | 84, 1971 | 149, 272 |
| A33D/N78S | 85, 1972 | 150, 272 |
| A33D/N78I | 86, 1973 | 151, 274 |
| A33D/N45T | 87, 1974 | 152, 275 |
| A33D/N45T/N78I | 88, 1975 | 153, 276 |
| E27G/N45T/V50A | 89, 1976 | 154, 277 |
| N45T/V50A/N78S | 90, 1977 | 155, 278 |
| I20L/N45T/V110M | 91, 1978 | 156, 279 |

TABLE 2-continued

Exemplary PD-L1 IRBMs containing an IgD or vIgD

| Mutation(s) | ECD SEQ ID NO | IgV SEQ ID NO |
|---|---|---|
| I20L/I36T/N45T/V50A | 92, 1979 | 157, 280 |
| N45T/L74P/S75P | 93, 1980 | 158, 281 |
| N45T/S75P | 94, 1981 | 159, 282 |
| S75P/K106R | 95, 1982 | 160, 283 |
| S75P | 96, 1983 | 161, 284 |
| A33D/S75P | 97, 1984 | 162, 285 |
| A33D/S75P/D104G | 98, 1985 | 163, 286 |
| A33D/S75P | 99, 1986 | 164, 287 |
| I20L/E27G/N45T/V50A | 100, 1987 | 165, 288 |
| I20L/E27G/D43G/N45D/V58A/N78I | 101, 1988 | 166, 289 |
| I20L/D43G/N45D/V58A/N78I | 102, 1989 | 167, 290 |
| I20L/A33D/D43G/N45D/V58A/N78I | 103, 1990 | 168, 291 |
| I20L/D43G/N45D/N78I | 104, 1991 | 169, 292 |
| E27G/N45T/V50A/N78I | 105, 1992 | 170, 293 |
| N45T/V50A/N78I | 106, 1993 | 171, 294 |
| V11A/I20L/E27G/D43G/N45D/H51Y/S99G | 107, 1994 | 172, 295 |
| I20L/E27G/D43G/N45T/V50A | 108, 1995 | 173, 296 |
| I20L/K28E/D43G/N45D/V58A/Q89R | 109, 1996 | 174, 297 |
| I20L/I36T/N45D | 110, 1997 | 175, 298 |
| I20L/K28E/D43G/N45D/E53G/V58A/N78I | 111, 1998 | 176, 299 |
| A33D/D43G/N45D/V58A/S75P | 112, 1999 | 177, 300 |
| K23R/D43G/N45D | 113, 2000 | 178, 301 |
| I20L/D43G/N45D/V58A/N78I/D90G/G101D | 114, 2001 | 179, 302 |
| D43G/N45D/L56Q/V58A/G101G-ins (G101GG) | 115, 2002 | 180, 303 |
| I20L/K23E/D43G/N45D/V58A/N78I | 116, 2003 | 181, 304 |
| I20L/K23E/D43G/N45D/V50A/N78I | 117, 2004 | 182, 305 |
| T19I/E27G/N45I/V50A/N78I/M97K | 118, 2005 | 183, 306 |
| I20L/M41K/D43G/N45D | 119, 2006 | 184, 307 |
| K23R/N45T/N78I | 120, 2007 | 185, 308 |
| I20L/K28E/D43G/N45D/V58A/Q89R/ G101G-ins (G101GG) | 1725, 2008 | 1726, 1727 |
| K57R/S99G | 1729, 1819 | 1908, 1923 |
| K57R/S99G/F189L | 1730, 1820 | |
| M18V/M97L/F193S/R195G/E200K/H202Q | 1731, 1821 | |
| I36S/M41K/M97L/K144Q/R195G/E200K/ H202Q/L206F | 1732, 1822 | |
| C22R/Q65L/L124S/K144Q/R195G/E200N/ H202Q/T221L | 1733 | |
| M18V/I98L/L124S/P198T/L206F | 1734, 1823 | |
| S99G/N117S/I148V/K171R/R180S | 1735, 1824 | |
| I36T/M97L/A103V/Q155H | 1736, 1825 | |
| K28I/S99G | 1737, 1826 | 1909, 1924 |
| R195S | 1738, 1827 | |
| A79T/S99G/T185A/R195G/E200K/ H202Q/L206F | 1739, 1828 | |
| K57R/S99G/L124S/K144Q | 1740, 1829 | |
| K57R/S99G/R195G | 1741, 1830 | |
| D55V/M97L/S99G | 1742, 1831 | 1910, 1925 |
| E27G/I36T/D55N/M97L/K111E | 1743, 1832 | 1911, 1926 |
| E54G/M97L/S99G | 1744, 1833 | 1912, 1927 |
| G15A/I36T/M97L/K111E/H202Q | 1745, 1834 | |
| G15A/I36T/V129D | 1746, 1835 | |
| G15A/I36T/V129D/R195G | 1747, 1836 | |
| G15A/V129D | 1748, 1837 | |
| I36S/M97L | 1749, 1838 | 1913, 1928 |
| I36T/D55N/M97L/K111E/A204T | 1750, 1839 | |
| I36T/D55N/M97L/K111E/V129A/F173L | 1751, 1840 | |
| I36T/D55S/M97L/K111E/I148V/R180S | 1752, 1841 | |
| I36T/G52R/M97L/V112A/K144E/ V175A/P198T | 1753, 1842 | |
| I36T/I46V/D55G/M97L/K106E/K144E/ T185A/R195G | 1754, 1843 | |
| I36T/I83T/M97L/K144E/P198T | 1755, 1844 | |
| I36T/M97L/K111E | 1756, 1845 | 1914, 1929 |
| I36T/M97L/K144E/P198T | 1757, 1846 | |
| I36T/M97L/Q155H/F193S/N201Y | 1758, 1847 | |
| I36T/M97L/V129D | 1759, 1848 | |
| L35P/I36S/M97L/K111E | 1760, 1849 | 1915, 1930 |
| M18I/I36T/E53G/M97L/K144E/ E199G/V207A | 1761, 1850 | |
| M18T/I36T/D55N/M97L/K111E | 1762, 1851 | 1916, 1931 |
| M18V/M97L/T176N/R195G | 1763, 1852 | |
| M97L/S99G | 1764, 1853 | 1917, 1932 |
| N17D/M97L/S99G | 1765, 1854 | 1918, 1933 |

TABLE 2-continued

Exemplary PD-L1 IRBMs containing an IgD or vIgD

| Mutation(s) | ECD SEQ ID NO | IgV SEQ ID NO |
|---|---|---|
| S99G/T185A/R195G/P198T | 1766, 1855 | |
| V129D/H202Q | 1767, 1856 | |
| V129D/P198T | 1768, 1857 | |
| V129D/T150A | 1769, 1858 | |
| V93E/V129D | 1770, 1859 | |
| Y10F/M18V/S99G/Q138R/T203A | 1771, 1860 | |
| N45D | 1772, 1861 | 1919, 1934 |
| K160M/R195G | 1773, 1862 | |
| N45D/K144E | 1774, 1863 | |
| N45D/P198S | 1775, 1864 | |
| N45D/P198T | 1776, 1865 | |
| N45D/R195G | 1777, 1866 | |
| N45D/R195S | 1778, 1867 | |
| N45D/S131F | 1779, 1868 | |
| N45D/V58D | 1780, 1869 | 1920, 1935 |
| V129D/R195S | 1781, 1870 | |
| I98T/F173Y/L196S | 1782, 1871 | |
| N45D/E134G/L213P | 1783, 1872 | |
| N45D/F173I/S177C | 1784, 1873 | |
| N45D/I148V/R195G | 1785, 1874 | |
| N45D/K111T/R195G | 1786, 1875 | |
| N45D/N113Y/R195S | 1787, 1876 | |
| N45D/N165Y/E170G | 1788, 1877 | |
| N45D/Q89R/I98V | 1789, 1878 | 1921, 1936 |
| N45D/S131F/P198S | 1790, 1879 | |
| N45D/S75P/P198S | 1791, 1880 | |
| N45D/V50A/R195T | 1792, 1881 | |
| E27D/N45D/T183A/I188V | 1793, 1882 | |
| F173Y/T183I/L196S/T203A | 1794, 1883 | |
| K23N/N45D/S75P/N120S | 1795, 1884 | |
| N45D/G102D/R194W/R195G | 1796, 1885 | |
| N45D/G52V/Q121L/P198S | 1797, 1886 | |
| N45D/I148V/R195G/N201D | 1798, 1887 | |
| N45D/K111T/T183A/I188V | 1799, 1888 | |
| N45D/Q89R/F189S/P198S | 1800, 1889 | |
| N45D/S99G/C137R/V207A | 1801, 1890 | |
| N45D/T163I/K167R/R195G | 1802, 1891 | |
| N45D/T183A/T192S/R194G | 1803, 1892 | |
| N45D/V50A/I119T/K144E | 1804, 1893 | |
| T19A/N45D/K144E/R195G | 1805, 1894 | |
| V11E/N45D/T130A/P198T | 1806, 1895 | |
| V26A/N45D/T163I/T185A | 1807, 1896 | |
| K23N/N45D/L124S/K167T/R195G | 1808, 1897 | |
| K23N/N45D/Q73R/T163I | 1809, 1898 | |
| K28E/N45D/W149R/S158G/P198T | 1810, 1899 | |
| K28R/N45D/K57E/I98V/R195S | 1811, 1900 | |
| K28R/N45D/V129D/T163N/R195T | 1812, 1901 | |
| M41K/D43G/N45D/R64S/R195G | 1813, 1902 | |
| M41K/D43G/N45D/R64S/S99G | 1814, 1903 | 1922, 1937 |
| N45D/R68L/F173L/D197G/P198S | 1815, 1904 | |
| N45D/V50A/I148V/R195G/N201D | 1816, 1905 | |
| M41K/D43G/K44E/N45D/R195G/N201D | 1817, 1906 | |
| N45D/V50A/L124S/K144E/L179P/R195G | 1818, 1907 | |

b. PD-L2 IgD or vIgD

Provided herein are immunomodulatory proteins containing an IRBM that is or contains one or more IgD domain, such as an unmodified or wild-type IgD or a vIgD, of PD-L2. In some embodiments, the IRBM is or contains one or more IgD domain of a wild-type or unmodified PD-L2, such as a mammalian PD-L1, e.g. a human PD-L1. In some embodiments, the IRBM is not the full length sequence of the PD-L2. In some aspects, the IRBM is a soluble polypeptide, is not membrane-expressed and/or lacks the transmembrane and/or cytoplasmic domain of PD-L2. In some embodiments, the IRBM only contains an extracellular domain (ECD) or a specific binding fragment thereof containing a IgD or vIgD, such as only contains an IgV domain or an IgC domain or specific binding fragment thereof, or combinations thereof.

In some embodiments, the IRBM is or contains the ECD sequence set forth in SEQ ID NO:31 or is a specific binding fragment thereof. In some embodiments, the IRBM is or contains the IgV sequence set forth in SEQ ID NO: 1203 or SEQ ID NO:1263 (containing residues 1-98 or 1-102, respectively, of SEQ ID NO:31), or is a specific binding fragment thereof.

```
                                        (SEQ ID NO: 31)
LFTVTVPKELYIIEHGSNVTLECNFDTGSHVNLGAITASLQKVENDTSPH

RERATLLEEQLPLGKASFHIPQVQVRDEGQYQCIIIYGVAWDYKYLTLKV

KASYRKINTHILKVPETDEVELTCQATGYPLAEVSWPNVSVPANTSHSRT

PEGLYQVTSVLRLKPPPGRNFSCVFWNTHVRELTLASIDLQSQMEPRTHP

T

                                       (SEQ ID NO: 1203)
FTVTVPKELYIIEHGSNVTLECNFDTGSHVNLGAITASLQKVENDTSPHR

ERATLLEEQLPLGKASFHIPQVQVRDEGQYQCIIIYGVAWDYKYLTLK

                                       (SEQ ID NO: 1263)
LFTVTVPKELYIIEHGSNVTLECNFDTGSHVNLGAITASLQKVENDTSPH

RERATLLEEQLPLGKASFHIPQVQVRDEGQYQCIIIYGVAWDYKYLTLKV

KA
```

In some embodiments, the immunomodulatory protein contains an IRBM that is or contains a vIgD containing one or more amino acid modifications, e.g. substitutions, in an IgD of a wild-type or unmodified PD-L2. In some embodiments, modifications provided herein can be in an IRBM containing an unmodified IgD set forth in SEQ ID NO:31, 1203 or 1263 or in a sequence that has 85%, 85%, 87%, 88%, 89%, 90%, 91%, 92%, 93%, 94%, 95%, 96%, 97%, 98%, 99% or more sequence identity to SEQ ID NO: 31, 1203 or 1263. In some embodiments, an IRBM containing a vIgD of PD-L2 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 31, 1203 or 1263.

In some embodiments, the vIgD is an affinity-modified IgSF domain that has an increased binding activity, such as binding affinity, for PD-1 relative to the binding activity of the wild-type or unmodified IgD for PD-1. In some embodiments, the increase in binding activity, e.g. binding affinity, for PD-1 is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions). In some embodiments, the equilibrium dissociation constant ($K_d$) of the IRBM to PD-1 can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less.

Unless stated otherwise, the amino acid modification(s) present in a vIgD of a PD-L2 ECD or an IgD (e.g. IgV) thereof are designated by amino acid position number corresponding to the numbering of positions of the unmodified ECD sequence set forth in SEQ ID NO:31 or, where applicable, the unmodified IgV sequence set forth in SEQ ID NO: 1263. It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs: 31 or 1263. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the IRBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified PD-L2. In some embodiments, the one or more amino acid modifications, e.g. substitutions, are in the ECD domain of PD-L2 or a specific binding fragment thereof. In some embodiments, the one or more amino acid modifications, e.g. substitutions, are in the IgV domain of PD-L2 or a specific binding fragment thereof. In some embodiments, the one or more amino acid modifications, e.g. substitutions, are in an IgC domain of PD-L2 or a specific binding fragment thereof. In some embodiments, the one or more amino acid modifications, e.g. substitutions, are in the IgV domain of PD-L2 or a specific binding fragment thereof and in an IgC domain or domains of PD-L2 or a specific binding fragment thereof.

In some embodiments, the IRBM is or contains a vIgD that has one or more amino acid modifications, e.g. substitutions in an unmodified IgD of PD-L2 or specific binding fragment thereof corresponding to position(s) 2, 12, 13, 15, 18, 20, 23, 24, 28, 31, 32, 33, 36, 37, 39, 44, 45, 46, 47, 48, 58, 59, 65, 67, 69, 71, 72, 73, 74, 75, 76, 77, 82, 85, 86, 89, or 91 with reference to positions set forth in SEQ ID NO: 31. In some cases, a polypeptide containing the vIgD exhibits increased binding activity, e.g. binding affinity, to PD-1 compared to a polypeptide containing the wild-type or unmodified PD-L2 IgD.

In some embodiments, the IRBM is or contains a vIgD that has one or more amino acid modification, e.g. substitution, selected from F2L, I12V, I13V, H15Q, N18D, T20A, N24S, C23S, G28V, N24D, V31A, V31M, N32D, L33P, L33H, L33F, I36V, T37A, S48C, S39I, E44D, N45S, D46E, T47A, E58G, E59G, K65R, S67L, H69L, P71S, Q72H, V73A, Q74R, R76G, D77N, Q82R, I85F, I86T, V89D, or W91R, or a conservative amino acid substitution thereof.

In some embodiments, the IRBM is or contains a vIgD that has two or more amino acid modification, e.g. substitution, selected from F2L, I12V, I13V, H15Q, N18D, T20A, N24S, C23S, G28V, N24D, V31A, V31M, N32D, L33P, L33H, L33F, I36V, T37A, S48C, S39I, E44D, N45S, D46E, T47A, E58G, E59G, K65R, S67L, H69L, P71S, Q72H, V73A, Q74R, R76G, D77N, Q82R, I85F, I86T, V89D, W91R.

In some embodiments, the amino acid modification(s), e.g. substitution(s), is H15Q, N24D, E44D, V89D, Q82R/V89D, E59G/Q82R, S39I/V89D, S67L/V89D, S67L/I85F, S67L/I86T, H15Q/K65R, H15Q/Q72H/V89D, H15Q/S67L/R76G, H15Q/R76G/I85F, H15Q/T47A/Q82R, H15Q/Q82R/V89D, H15Q/C23S/I86T, H15Q/S39I/I86T, E44D/V89D/W91R, I13V/S67L/V89D, H15Q/S67L/I86T, I13V/

H15Q/S67L/I86T, I13V/H15Q/E44D/V89D, I13V/S39I/E44D/Q82R/V89D, I13V/E44D/Q82R/V89D, I13V/Q72H/R76G/I86T, I13V/H15Q/R76G/I85F, H15Q/S39I/R76G/V89D, H15Q/S67L/R76G/I85F, H15Q/T47A/Q72H/R76G/I86T, H15Q/T47A/Q72H/R76G, I13V/H15Q/T47A/Q72H/R76G, H15Q/E44D/R76G/I85F, H15Q/S39I/S67L/V89D, H15Q/N32D/S67L/V89D, N32D/S67L/V89D, H15Q/S67L/Q72H/R76G/V89D, H15Q/Q72H/Q74R/R76G/I86T, G28V/Q72H/R76G/I86T, I13V/H15Q/S39I/E44D/S67L, E44D/S67L/Q72H/Q82R/V89D, H15Q/V89D, H15Q/T47A, I13V/H15Q/Q82R, I13V/H15Q/V89D, I13V/S67L/Q82R/V89D, I13V/H15Q/Q82R/V89D, H15Q/V31M/S67L/Q82R/V89D, I13V/H15Q/T47A/Q82R, I13V/H15Q/V31A/N45S/Q82R/V89D, H15Q/T47A/H69L/Q82R/V89D, I13V/H15Q/T47A/H69L/R76G/V89D, I12V/I13V/H15Q/T47A/Q82R/V89D, I13V/H15Q/R76G/D77N/Q82R/V89D, I13V/H15Q/T47A/R76G/V89D, I13V/H15Q/T47A/Q82R/V89D, I13V/H15Q/N24D/Q82R/V89D, I13V/H15Q/I36V/T47A/S67L/V89D, H15Q/T47A/K65R/S67L/Q82R/V89D, H15Q/L33P/T47A/S67L/P71S/V89D, I13V/H15Q/Q72H/R76G/I86T, H15Q/T47A/S67L/Q82R/V89D, F2L/H15Q/D46E/T47A/Q72H/R76G/Q82R/V89D, I13V/H15Q/L33F/T47A/Q82R/V89D, I13V/H15Q/T47A/E58G/S67L/Q82R/V89D, H15Q/N24S/T47A/Q72H/R76G/V89D, I13V/H15Q/E44V/T47A/Q82R/V89D, H15Q/N18D/T47A/Q72H/V73A/R76G/I86T/V89D, I13V/H15Q/T37A/E44D/S48C/S67L/Q82R/V89D, H15Q/L33H/S67L/R76G/Q82R/V89D, I13V/H15Q/T47A/Q72H/R76G/I86T, H15Q/S39I/E44D/Q72H/V75G/R76G/Q82R/V89D, H15Q/T47A/S67L/R76G/Q82R/V89D, or I13V/H15Q/T47A/S67L/Q72H/R76G/Q82R/V89D.

In some embodiments, the IRBM contains a vIgD that has one or more amino acid modification, e.g. substitutions, in an unmodified PD-L2 or specific binding fragment thereof corresponding to position(s) 13, 15, 47, 67, 72, 76, 82, 86, and/or 89 with reference to positions set forth in SEQ ID NO:36 or 2655. In some embodiments, the IRBM is or contains a vIgD of PD-L1 that has one or more amino acid modifications selected from I13V, H15Q, T47A, S67L, Q72H, R76G, Q82R, I86T, and/or V89D, or a conservative amino acid substitution thereof.

In some embodiments, the IRBM is or contains an IgD (e.g. IgV) of wild-type PD-L2 set forth in Table 3 or a vIgD comprising any of the modifications (e.g. substitutions) listed in Table 3. Table 3 also provides exemplary sequences by reference to SEQ ID NO for IRBMs containing an ECD or IgV domain. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in an IRBM, such as to ensure proper folding of the domain when expressed. Thus, it is understood that the exemplification of the SEQ ID NOS in Table 3 is not to be construed as limiting. For example, the particular domain, such as the ECD or IgV domain, can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the IRBM is or contains a wild-type PD-L2 ECD set forth in SEQ ID NO:31 or a variant ECD sequence set forth in any one of SEQ ID NOS: 1204-1280. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the ECD sequences set forth in any one of SEQ ID NOS: 1204-1280 and contains the amino acid modification(s), e.g. substitution(s) not present in the wild-type or unmodified PD-L2, e.g. not present in SEQ ID NO:31. In some embodiments, the IRBM is or contains a specific binding fragment of any of the ECD set forth in any one of SEQ ID NOS: 1204-1280 and contains the amino acid modification(s), e.g. substitution(s) not present in the wild-type or unmodified PD-L2 ECD, e.g. not present in SEQ ID NO:31.

In some embodiments, the IRBM is or contains a wild-type PD-L2 IgV set forth in SEQ ID NO: 1203 or 1263 or a variant IgV set forth in any one of SEQ ID NOS: 1283-1331, 1333-1407, 1309-1432. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 1283-1331, 1333-1407, 1309-1432 and contains the amino acid substitution(s) not present in the wild-type or unmodified PD-L2 IgV, e.g. not present in SEQ ID NO:1203 or 1263. In some embodiments, the IRBM is or contains a specific binding fragment of any of the IgV sequences set forth in any one of SEQ ID NOS: 1283-1331, 1333-1407, 1309-1432 and that contains the amino acid modification(s), e.g., substitution(s) not present in the wild-type or unmodified PD-L2 IgV, e.g. not present in SEQ ID NO:1203 or 1263.

TABLE 3

Exemplary PD-L2 IRBMs containing an IgD or vIgD

| Mutation(s) | ECD SEQ ID NO | IgV SEQ ID NO |
|---|---|---|
| Wild-type | 31 | 1203, 1263 |
| H15Q | 1204 | 1281, 1357 |
| N24D | 1205 | 1282, 1358 |
| E44D | 1206 | 1283, 1359 |
| V89D | 1207 | 1284, 1360 |
| Q82R/V89D | 1208 | 1285, 1361 |
| E59G/Q82R | 1209 | 1286, 1362 |
| S39I/V89D | 1210 | 1287, 1363 |
| S67L/V89D | 1211 | 1288, 1364 |
| S67L/I85F | 1212 | 1289, 1365 |
| S67L/I86T | 1213 | 1290, 1366 |
| H15Q/K65R | 1214 | 1291, 1367 |
| H15Q/Q72H/V89D | 1215 | 1292, 1368 |
| H15Q/S67L/R76G | 1216 | 1293, 1369 |
| H15Q/R76G/I85F | 1217 | 1294, 1370 |
| H15Q/T47A/Q82R | 1218 | 1295, 1371 |
| H15Q/Q82R/V89D | 1219 | 1296, 1372 |
| H15Q/C23S/I86T | 1220 | 1297, 1373 |
| H15Q/S39I/I86T | 1221 | 1298, 1374 |
| H15Q/R76G/I85F | 1222 | 1299, 1375 |
| E44D/V89D/W91R | 1223 | 1300, 1376 |
| I13V/S67L/V89D | 1224 | 1301, 1377 |
| H15Q/S67L/I86T | 1225 | 1302, 1378 |
| I13V/H15Q/S67L/I86T | 1226 | 1303, 1379 |
| I13V/H15Q/E44D/V89D | 1227 | 1304, 1380 |
| I13V/S39I/E44D/Q82R/V89D | 1228 | 1305, 1381 |
| I13V/E44D/Q82R/V89D | 1229 | 1306, 1382 |
| I13V/Q72H/R76G/I86T | 1230 | 1307, 1383 |
| I13V/H15Q/R76G/I85F | 1231 | 1308, 1384 |
| H15Q/S39I/R76G/V89D | 1232 | 1309, 1385 |
| H15Q/S67L/R76G/I85F | 1233 | 1310, 1386 |
| H15Q/T47A/Q72H/R76G/I86T | 1234 | 1311, 1387 |
| H15Q/T47A/Q72H/R76G | 1235 | 1312, 1388 |
| I13V/H15Q/T47A/Q72H/R76G | 1236 | 1313, 1389 |
| H15Q/E44D/R76G/I85F | 1237 | 1314, 1390 |
| H15Q/S39I/S67L/V89D | 1238 | 1315, 1391 |
| H15Q/N32D/S67L/V89D | 1239 | 1316, 1392 |
| N32D/S67L/V89D | 1240 | 1317, 1393 |
| H15Q/S67L/Q72H/R76G/V89D | 1241 | 1318, 1394 |

TABLE 3-continued

| Exemplary PD-L2 IRBMs containing an IgD or vIgD | | |
|---|---|---|
| Mutation(s) | ECD SEQ ID NO | IgV SEQ ID NO |
| H15Q/Q72H/Q74R/R76G/I86T | 1242 | 1319, 1395 |
| G28V/Q72H/R76G/I86T | 1243 | 1320, 1396 |
| I13V/H15Q/S39I/E44D/S67L | 1244 | 1321, 1397 |
| E44D/S67L/Q72H/Q82R/V89D | 1245 | 1322, 1398 |
| H15Q/V89D | 1246 | 1323, 1399 |
| H15Q/T47A | 1247 | 1324, 1400 |
| I13V/H15Q/Q82R | 1248 | 1325, 1401 |
| I13V/H15Q/V89D | 1249 | 1326, 1402 |
| I13V/S67L/Q82R/V89D | 1250 | 1327, 1403 |
| I13V/H15Q/Q82R/V89D | 1251 | 1328, 1404 |
| H15Q/V31M/S67L/Q82R/V89D | 1252 | 1329, 1405 |
| I13V/H15Q/T47A/Q82R | 1253 | 1330, 1406 |
| I13V/H15Q/V31A/N45S/Q82R/V89D | 1254 | 1331, 1407 |
| H15Q/T47A/H69L/Q82R/V89D | 1256 | 1333, 1409 |
| I13V/H15Q/T47A/H69L/R76G/V89D | 1257 | 1334, 1410 |
| I12V/I13V/H15Q/T47A/Q82R/V89D | 1258 | 1335, 1411 |
| I13V/H15Q/R76G/D77N/Q82R/V89D | 1259 | 1336, 1412 |
| I13V/H15Q/T47A/R76G/V89D | 1260 | 1337, 1413 |
| I13V/H15Q/T47A/Q82R/V89D | 1261 | 1338, 1414 |
| I13V/H15Q/N24D/Q82R/V89D | 1262 | 1339, 1415 |
| I13V/H15Q/I36V/T47A/S67L/V89D | 1264 | 1340, 1416 |
| H15Q/T47A/K65R/S67L/Q82R/V89D | 1265 | 1341, 1417 |
| H15Q/L33P/T47A/S67L/P71S/V89D | 1266 | 1342, 1418 |
| I13V/H15Q/Q72H/R76G/I86T | 1267 | 1343, 1419 |
| H15Q/T47A/S67L/Q82R/V89D | 1268 | 1344, 1420 |
| F2L/H15Q/D46E/T47A/Q72H/R76G/Q82R/V89D | 1269 | 1345, 1421 |
| I13V/H15Q/L33F/T47A/Q82R/V89D | 1270 | 1346, 1422 |
| I13V/H15Q/T47A/E58G/S67L/Q82R/V89D | 1271 | 1347, 1423 |
| H15Q/N24S/T47A/Q72H/R76G/V89D | 1272 | 1348, 1424 |
| I13V/H15Q/E44V/T47A/Q82R/V89D | 1273 | 1349, 1425 |
| H15Q/N18D/T47A/Q72H/V73A/R76G/I86T/V89D | 1274 | 1350, 1426 |
| I13V/H15Q/T37A/E44D/S48C/S67L/Q82R/V89D | 1275 | 1351, 1427 |
| H15Q/L33H/S67L/R76G/Q82R/V89D | 1276 | 1352, 1428 |
| I13V/H15Q/T47A/Q72H/R76G/I86T | 1277 | 1353, 1429 |
| H15Q/S39I/E44D/Q72H/V75G/R76G/Q82R/V89D | 1278 | 1354, 1430 |
| H15Q/T47A/S67L/R76G/Q82R/V89D | 1279 | 1355, 1431 |
| I13V/H15Q/T47A/S67L/Q72H/R76G/Q82R/V89D | 1280 | 1356, 1432 |

2. TIGIT-Binding Molecules

Provided are immunomodulatory proteins containing an IRBM that is or contains a binding molecule that binds to TIGIT, such as to human TIGIT. Engagement of TIGIT (T cell immunoreceptor with Ig and ITIM domains) inhibits or down-modulate immune responses. TIGIT, which can be expressed on NK cells and T cells, can suppress or inhibit the cytolytic activity of NK cells, T cell proliferation and/or proinflammatory cytokine production. In some embodiments, the IRBM of the immunomodulatory protein binds to the ectodomain of TIGIT. In some embodiments, the IRBM binds to TIGIT on the surface of a cell, such as on the surface of a T cell.

In some embodiments, the provided immunomodulatory protein contains an IRBM that is or contains an antibody that binds TIGIT or is an antigen-binding antibody fragment thereof (e.g. Fab or scFv). In some embodiments, the antibody or antigen-binding antibody fragment binds human TIGIT. For example, in some embodiments, the antibody is BMS-986207, OMP-313M32, or RG6058 (MTIG7192A), or an antigen binding fragment containing a VH chain region and/or VL chain region of BMS-986207, OMP-313M32, or RG6058 (MTIG7192A). In some embodiments, the antibody is a single chain variable fragment (e.g. scFv) containing a VH and VL of BMS-986207, OMP-313M32, or RG6058 (MTIG7192A).

In some embodiments, the IRBM is or contains one or more IgD (e.g. IgV or IgC) or a specific binding fragment thereof, such as an unmodified or wild-type IgD or a vIgD or a specific binding fragment thereof, of an IgSF family member that binds TIGIT. In some embodiments, the TIGIT is human TIGIT. The ligands CD155 (also known as the poliovirus receptor, PVR) and CD112 (also known as Nectin-2), which are normally expressed on the surface of APCs (e.g. dendritic cells) can bind TIGIT to inhibit or down-modulate immune responses.

In some embodiments, the IRBM is or contains one or more IgD (e.g. IgV or IgC) that is an IgD of a CD112 or CD155 polypeptide, such as a wild-type CD112 or CD155, e.g. a human CD112 or a human CD155. In some aspects, the IRBM contains one or more IgD (e.g. IgV or IgC) that is a vIgD containing one or more amino acid modifications (e.g., substitutions, deletions or additions) compared to an IgD of a wild-type or unmodified CD112 or CD155, which, in some aspects, result in increased binding to TIGIT. Exemplary IgDs or vIgDs of CD112 or CD155 binding partners for inclusion as an IRBM in the provided immunomodulatory proteins are described. In some embodiments, the IRBM is or contains a vIgD polypeptide that exhibit increased binding activity or affinity for TIGIT compared to a corresponding wild-type or unmodified IgD.

In some aspects, a vIgD of CD112 or CD155 may exhibit increased binding activity, e.g. binding affinity, to the activating receptor CD226. In such examples, such a vIgD may be used as an ARBM in the embodiments provided herein. In some embodiments, such an ARBM exhibits a greater binding activity, e.g. binding affinity, for CD226 than for TIGIT, such as a binding activity, e.g. binding affinity, that is at least 1.2-fold, 1.5-fold, 2.0-fold, 3.0-fold, 4.0-fold, 5.0-fold or 10.0-fold greater for CD226 than for TIGIT.

a. CD155 IgD or vIgD

Provided herein are immunomodulatory proteins containing an IRBM that is or contains one or more IgD domain, such as an unmodified or wild-type IgD or a vIgD, of CD155. In some embodiments, the IRBM is or contains one or more IgD domain of a wild-type or unmodified CD155, such as a mammalian CD155, e.g. a human CD155. In some embodiments, the IRBM is not the full length sequence of the CD155. In some aspects, the IRBM is a soluble polypeptide, is not membrane-expressed and/or lacks the transmembrane and/or cytoplasmic domain of CD155. In some embodiments, the IRBM only contains an extracellular domain (ECD) or a specific binding fragment thereof containing a IgD or vIgD, such as only contains an IgV domain or an IgC domain or specific binding fragment thereof, or combinations thereof.

In some embodiments, the IRBM is or contains the ECD sequence set forth in SEQ ID NO:47 or is a specific binding fragment thereof. In some embodiments, the IRBM is or contains the IgV sequence set forth in SEQ ID NO: 310 or SEQ ID NO: 353, or is a specific binding fragment thereof.

```
                                          (SEQ ID NO: 47)
WPPPGTGDVVVQAPTQVPGFLGDSVTLPCYLQVPNMEVTHVSQLTWARHG

ESGSMAVFHQTQGPSYSESKRLEFVAARLGAELRNASLRMFGLRVEDEGN

YTCLFVTFPQGSRSVDIWLRVLAKPQNTAEVQKVQLTGEPVPMARCVSTG

GRPPAQITWHSDLGGMPNTSQVPGFLSGTVTVTSLWILVPSSQVDGKNVT

CKVEHESFEKPQLLTVNLTVYYPPEVSISGYDNNWYLGQNEATLTCDARS

NPEPTGYNWSTTMGPLPPFAVAQGAQLLIRPVDKPINTTLICNVTNALGA

RQAELTVQVKEGPPSEHSGISRN
```

-continued (SEQ ID NO: 310)
PGTGDVVVQAPTQVPGFLGDSVTLPCYLQVPNMEVTHVSQLTWARHGESG

SMAVFHQTQGPSYSESKRLEFVAARLGAELRNASLRMFGLRVEDEGNYTC

LFVTFPQGSRSVDIWL (SEQ ID NO: 353)
WPPPGTGDVVVQAPTQVPGFLGDSVTLPCYLQVPNMEVTHVSQLTWARHG

ESGSMAVFHQTQGPSYSESKRLEFVAARLGAELRNASLRMFGLRVEDEGN

YTCLFVTFPQGSRSVDIWLRVL

In some embodiments, the immunomodulatory protein contains an IRBM that is or contains a vIgD containing one or more amino acid modifications, e.g. substitutions, in an IgD of a wild-type or unmodified CD155. In some embodiments, modifications provided herein can be in an IRBM containing an unmodified IgD set forth in SEQ ID NO:37, 310 or 353 or in a sequence that has 85%, 85%, 87%, 88%, 89%, 90%, 91%, 92%, 93%, 94%, 95%, 96%, 97%, 98%, 99% or more sequence identity to SEQ ID NO: 37, 310 or 353. In some embodiments, an IRBM containing a vIgD of CD155 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 37, 310 or 353.

In some embodiments, the vIgD is an affinity-modified IgSF domain that has an increased binding activity, such as binding affinity, for TIGIT relative to the binding affinity of the wild-type or unmodified IgD for TIGIT. In some embodiments, the increase in binding activity, e.g. binding affinity, for TIGIT is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions). In some embodiments, the equilibrium dissociation constant ($K_d$) of the IRBM to TIGIT can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less.

In some aspects, a vIgD of CD155 may exhibit increased binding activity, e.g. binding affinity, to the activating receptor CD226. In some embodiments, the increase in binding activity, e.g. binding affinity, for TIGIT is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, such a vIgD may be used as an ARBM in the embodiments provided herein. In some embodiments, the equilibrium dissociation constant ($K_d$) of the ARBM to CD226 can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less. In some embodiments, such an ARBM exhibits a greater binding activity, e.g. binding affinity, for CD226 than for TIGIT, such as a binding activity, e.g. binding affinity, that is at least 1.2-fold, 1.5-fold, 2.0-fold, 3.0-fold, 4.0-fold, 5.0-fold or 10.0-fold greater for CD226 than for TIGIT.

Unless stated otherwise, the amino acid modification(s) present in a vIgD of a CD155 ECD or an IgD (e.g. IgV) thereof are designated by amino acid position number corresponding to the numbering of positions of the unmodified ECD sequence set forth in SEQ ID NO:47 or, where applicable, the unmodified IgV sequence set forth in SEQ ID NO: 353. It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs: 47 or 353. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a “del” is indicated and if the modification is an insertion at the position an “ins” is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the IRBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified CD155. In some embodiments, the one or more amino acid modifications, e.g. substitutions, are in the ECD domain of CD155 or a specific binding fragment thereof. In some embodiments, the one or more amino acid modifications, e.g. substitutions, are in the IgV domain of CD155 or a specific binding fragment thereof. In some embodiments, the one or more amino acid modifications, e.g. substitutions, are in an IgC domain of CD155 or a specific binding fragment thereof. In some embodiments, the one or more amino acid modifications, e.g. substitutions, are in the IgV domain of CD155 or a specific binding fragment thereof and in an IgC domain or domains of CD155 or a specific binding fragment thereof.

In some embodiments, the IRBM is or contains a vIgD that has one or more amino acid modification, e.g. substitutions, in an unmodified IgD of CD155 or specific binding fragment thereof corresponding to position(s) 7, 8, 9, 10, 11, 12, 13, 15, 16, 18, 19, 20, 21, 22, 23, 24, 25, 26, 29, 30, 32, 33, 34, 35, 36, 37, 38, 39, 40, 41, 42, 44, 45, 46, 47, 48, 49, 50, 51, 52, 53, 54, 55, 56, 57, 58, 59, 60, 61, 62, 64, 65, 67, 68, 69, 70, 72, 73, 75, 76, 77, 78, 79, 80, 81, 82, 83, 84, 85, 87, 88, 89, 90, 91, 92, 94, 95, 96, 97, 98, 99, 100, 102, 104, 106, 107, 108, 110, 111, 112, 113, 114, 115, or 116 with reference to positions set forth in SEQ ID NO: 47. In some embodiments, a polypeptide containing the vIgD exhibits altered, such as increased, binding activity, e.g. binding affinity, to TIGIT compared to a polypeptide containing the wild-type or unmodified CD155 IgD.

In some embodiments, the IRBM is or contains a vIgD of CD155 that has one or more amino acid modifications selected from G7E, D8G, V9A, V9D, V91, V9L, V10F, V10G, V10I, V11A, V11E, V11M, Q12H, Q12K, Q12L, A13E, A13R, T151, T155, Q16H, P18C, P18F, P18H, P18L, P185, P18T, P18Y, G19D, F20I, F205, F20Y, L21S, L21M, G22S, D23A, D23G, D23N, D23Y, S24A, S24P, V25A, V25E, T26M, C29R, Y30C, Y30F, Y30H, Q32L, Q32R, V33M, P34S, N35D, N35F, N35S, M36I, M36R, M36T, E37G, E37P, E37S, E37V, V38A, V38G, T39A, T39S, H40Q, H40R, H40T, V41A, V41M, S42A, S42C, S42G, S42L, S42N, S42P, S42Q, S42T, S42V, S42W, L44P, L44V, T45A, T45G, T45I, T45S, T45Q, T45V, W46C, W46R, A47E, A47G, A47V, R48Q, H49L, H49Q, H49R, G50S, E51G, E51K, E51V, S52A, S52E, S52G, S52K, 552L, S52M, S52P, S52Q, S52R, S52T, S52W, G53R, S54C, S54G, S54H, S54N, S54R, M55I, M55L, M55V, A56V, V57A, V57L, V57T, F58L, F58Y, H59E, H59N, N59R, Q60H, Q60K, Q60P, Q60R, T61A, T61G, T61K, T61M, T61R, T61S, Q62F, Q62H, Q62K, Q62L, Q62M, Q62R, Q62Y, P64S, S65A, 565C, 565G, S65D, 565T, 565Y, S65H, S65N, 565T, 565W, S67A, S67E, S67G, S67H, S67L, S67T, S67V, S67W, E68G, S69L, S69P, K70E, K70R, K70Q, L72Q, E73D, E73G, E73R, V75A, V75L, A76E, A76G, A76T, A77T, A77V, R78G, R78K, R78S, L79P, L79Q, L79V, G80D, G805, A81E, A81P, A81T, A81V, E82D, E82G, L83P, L83Q, R84W, N85D, N85Y, N87T, L88P, R89K, M901, M90L, M90V, F91S, F91P, F91T, G92A, G92E, G92W, R94H, V95A, E96D, D97G, E98D, E98S, G99D, G99Y, N100Y, T1025, L104E, L104M, L104N, L104P, L104Q, L104T, L104Y, V106A, V106I, V106L, T107A, T107L, T107M, T1075, T107V, F108H, F108L, F108Y, Q110R, G111D, G111R, S112I, S112N, S112V, R113G, R113W, S114N, S114T, V115A, V115M, D116G, or D116N, or a conservative amino acid substitution thereof.

In some embodiments, the IRBM is or contains a vIgD that has two or more amino acid modifications selected from G7E, D8G, V9A, V9D, V91, V9L, V10F, V10G, V10I, V11A, V11E, V11M, Q12H, Q12K, Q12L, A13E, A13R, T151, T15S, Q16H, P18C, P18F, P18H, P18L, P18S, P18T, P18Y, G19D, F20I, F20S, F20Y, L21S, L21M, G22S, D23A, D23G, D23N, D23Y, S24A, S24P, V25A, V25E, T26M, C29R, Y30C, Y30F, Y30H, Q32L, Q32R, V33M, P34S, N35D, N35F, N35S, M36I, M36R, M36T, E37G, E37P, E37S, E37V, V38A, V38G, T39A, T39S, H40Q, H40R, H40T, V41A, V41M, S42A, S42C, S42G, S42L, S42N, S42P, S42Q, S42T, S42V, S42W, L44P, L44V, T45A, T45G, T45I, T45S, T45Q, T45V, W46C, W46R, A47E, A47G, A47V, R48Q, H49L, H49Q, H49R, G50S, E51G, E51K, E51V, S52A, S52E, S52G, S52K, S52L, S52M, S52P, S52Q, S52R, S52T, S52W, G53R, S54C, S54G, S54H, S54N, S54R, M55I, M55L, M55V, A56V, V57A, V57L, V57T, F58L, F58Y, H59E, H59N, N59R, Q60H, Q60K, Q60P, Q60R, T61A, T61G, T61K, T61M, T61R, T61S, Q62F, Q62H, Q62K, Q62L, Q62M, Q62R, Q62Y, P64S, S65A, S65C, S65G, S65D, S65T, S65Y, S65H, S65N, S65T, S65W, S67A, S67E, S67G, S67H, S67L, S67T, S67V, S67W, E68D, E68G, S69L, S69P, K70E, K70R, K70Q, L72Q, E73D, E73G, E73R, V75A, V75L, A76E, A76G, A76T, A77T, A77V, R78G, R78K, R78S, L79P, L79Q, L79V, G80D, G80S, A81E, A81P, A81T, A81V, E82D, E82G, L83P, L83Q, R84W, N85D, N85Y, N87T, L88P, R89K, M901, M90L, M90V, F91S, F91T, F91P, G92A, G92E, G92W, R94H, V95A, E96D, D97G, E98D, E98S, G99D, G99Y, N100Y, T102S, L104E, L104M, L104N, L104P, L104Q, L104T, L104Y, V106A, V106I, V106L, T107A, T107L, T107M, T107S, T107V, F108H, F108L, F108Y, Q110R, G111D, G111R, S112I, S112N, S112V, R113G, R113W, S114N, S114T, V115A, V115M, D116G, or D116N.

In some embodiments, the amino acid modification(s), e.g. substitutions(s), is P18S/P64S/F91S, P18S/F91S/L104P, P18L/L79V/F91S, P18S/F91S, P18T/F91S, P18T/S42P/F91S, G7E/P18T/Y30C/F91S, P18T/F91S/G111D, P18S/F91P, P18T/F91S/F108L, P18S/F91S, P18T/T45A/F91S, P18T/F91S/R94H, P18S/Y30C/F91S, A81V/L83P, A13E/P18S/A56V/F91S, P18T/F91S/V115A, P18T/Q60K, S52M, T45Q/S52L/L104E/G111R, S42G, Q62F, S52Q, S42A/L104Q/G111R, S42A/S52Q/L104Q/G111R, S52W/L104E, S42C, S52W, S52M/L104Q, S42L/S52L/Q62F/L104Q, S42W, S42Q, S52L, S52R, L104E, G111R, S52E, Q62Y, T45Q/S52M/L104E, S42N/L104Q/G111R, S52M/V57L, S42N/S52Q/Q62F, S42A/S52L/L104E/G111R, S42W/S52Q/V57L/Q62Y, L104Q, S42L/S52Q/L104E, S42C/S52L, S42W/S52R/Q62Y/L104Q, T45Q/S52R/L104E, S52R/Q62F/L104Q/G111R, T45Q/S52L/V57L/L104E, S52M/Q62Y, Q62F/L104E/G111R, T45Q/S52Q, S52L/L104E, S42V/S52E, T45Q/S52R/G111R, S42G/S52Q/L104E/G111R, S42N/S52E/V57L/L104E, S42C/S52M/Q62F, S42L, S42A, S42G/S52L/Q62F/L104Q, S42N, P18T/S65A/S67V/F91S, P18F/T39A/T45Q/T61R/S65N/S67L/E73G/R78G, P18T/T45Q/T61R/S65N/S67L, P18F/S65A/S67V/F91S, P18F/T45Q/T61R/S65N/S67L/F91S/L104P, P18S/L79P/L104M, P18S/L104M, L79P/L104M, P18T/T45Q/L79P, P18T/T45Q/T61R/S65H/S67H, P18T/A81E, P18S/D23Y/E37P/S52G/Q62M/G80S/A81P/G99Y/S112N, A13R/D23Y/E37P/S42P/Q62Y/A81E, A13R/D23Y/E37P/G99Y/S112N, A13R/D23Y/E37P/Q62M/A77V/G80S/A81P/G99Y, P18L/E37S/Q62M/G80S/A81P/G99Y/S112N, P18S/L104T, P18S/Q62H/L79Q/F91S, T45Q/S52K/Q62F/L104Q/G111R, T45Q/S52Q/Q62Y/L104Q/G111R, T45Q/S52Q/Q62Y/L104E/G111R, V57A/T61M/S65W/S67A/E96D/L104T, P18L/V57T/T61S/S65Y/S67A/L104T, P18T/T45Q, P18L/V57A/T61M/S65W/S67A/L104T, T61M/S65W/S67A/L104T, P18S/V41A/S42G/T45G/L104N, P18H/S42G/T45I/S52T/G53R/S54H/V57L/H59E/T61S/S65D/E68G/L104N, P18S/S42G/T45V/F58L/S67W/L104N, P18S/T45I/L104N, P18S/S42G/T45G/L104N/V106A, P18H/H40R/S42G/T45I/S52T/G53R/S54H/V57L/H59E/T61S/S65D/E68G/L104Y/V106L/F108H, E37V/S42G/T45G/L104N, P18S/T45Q/L79P/L104T, P18L/Q62R, A13R/D23Y/E37P/S42L/S52G/Q62Y/A81E, P18L/H49R/L104T/D116N, A13R/D23Y/E37P/Q62M/G80S/A81P/L104T, S65T/L104T, A13R/D23Y/E37P/S52G/V57A/Q62M/K70E/L104T, P18L/A47V/Q62Y/E73D/L104T, H40T/V41M/A47V/S52Q/Q62L/S65T/E73R/D97G/E98S/L104T/D116N, P18L/S42P/T45Q/T61G/S65H/S67E/L104T/D116N, P18S/H40T/V41M/A47V/S52Q/Q62L/S65T/E73R/L104M/V106A, H40T/V41M/A47V/S52Q/Q62L/S65T/E68G/E73R/D97G/E98S/L104T, T45Q/S52E/L104E, T45Q/S52E/Q62F/L104E, P18F/T26M/L44V/Q62K/L79P/F91S/L104M/G111D, P18S/T45S/T61K/S65W/S67A/F91S/G111R, P18S/L79P/L104M/T107M, P18S/S65W/S67A/M90V/V95A/L104Q/G111R, P18S/A47G/L79P/F91S/L104M/T107A/R113W, P18T/D23G/S24A/N35D/H49L/L79P/F91S/L104M/G111R, V9L/P18S/Q60R/V75L/L79P/R89K/F91S/L104E/G111R, P18S/H49R/E73D/L79P/N85D/F91S/V95A/L104M/G111R, V11A/P18S/L79P/F91S/L104M/G111R, V11A/P18S/S54R/Q60P/Q62K/L79P/N85D/F91S/T107M, P18T/S52P/S65A/S67V/L79P/F91S/L104M/G111R, P18T/M36T/L79P/F91S/G111R, D8G/P18S/M36I/V38A/H49Q/A76E/F91S/L104M/T107A/R113W, P18S/S52P/S65A/S67V/L79P/F91S/L104M/T107S/R113W, T15I/P18T/L79P/F91S/L104M/G111R, P18F/T26M/L44V/Q62K/L79P/E82D/F91S/L104M/G111D, P18T/E37G/G53R/Q62K/L79P/F91S/E98D/L104M/T107M, P18L/K70E/L79P/F91S/V95A/G111R, V9I/Q12K/P18F/S65A/S67V/L79P/L104T/G111R/S1121, P18F/S65A/S67V/F91S/L104M/G111R, V9I/V10I/P18S/F20S/T45A/L79P/F91S/L104M/F108Y/G111R/S112V, V9L/P18L/L79P/M90I/F91S/T102S/L104M/G111R, P18C/T26M/L44V/M55I/Q62K/L79P/F91S/L104M/T107M, V9I/P18T/D23G/L79P/F91S/G111R, P18F/L79P/M90L/F91S/V95A/L104M/G111R, P18T/M36T/S65A/S67E/L79Q/A81T/F91S/G111R, V9L/P18T/Q62R/L79P/F91S/L104M/G111R, P18S/S65W/S67A/L104Q/G111R, P18T/G19D/M36T/

S54N/L79P/L83Q/F91S/T107M/F108Y, V9L/P18L/M55V/S69L/L79P/A81E/F91S/T 107M, P18F/H40Q/T61K/Q62K/L79P/F91S/L104M/T107V, P18S/Q32R/Q62K/R78G/L79P/F91S/T107A/R113W, Q12H/P18T/L21S/G22S/V57A/Q62R/L79P/F91S/T107M, V9I/P18S/S24P/H49Q/F58Y/Q60R/Q62K/L79P/F91S/T107M, P18T/W46C/H49R/S65A/S67V/A76T/L79P/S87T/L104M, P18S/S42T/E51G/L79P/F91S/G92W/T107M, V10F/T15S/P18L/R48Q/L79P/F91S/T107M/V115M, P18S/L21M/Y30F/N35D/R84W/F91S/T107M/D116G, P18F/E51V/S54G/Q60R/L79Q/E82G/S87T/M90I/F91S/G92R/T107M, Ql6H/P18F/F91S/T107M, P18T/D23G/Q60R/S67L/L79P/F91S/T107M/V115A, D8G/V9I/V11A/P18T/T26M/S52P/L79P/F91S/G92A/T107L/V115A, V9I/P18F/A47E/G50S/E68G/L79P/F91S/T107M, P18S/M55I/Q62K/S69P/L79P/F91S/T107M, P18T/T39S/S52P/S54R/L79P/F91S/T107M, P18S/D23N/L79P/F91S/T107M/S114N, P18S/P34S/E51V/L79P/F91S/G111R, P18S/H59N/V75A/L79P/A81T/F91S/L104M/T107M, P18S/W46R/E68D/L79P/F91S/T107M/R113G, V9L/P18F/T45A/S65A/S67V/R78K/L79V/F91S/T107M/S114T, P18T/M55L/T61R/L79P/F91S/V106I/T107M, T15I/P18S/V33M/N35F/T39S/M55L/R78S/L79P/F91S/T107M, P18S/Q62K/K70E/L79P/F91S/G92E/R113W, P18F/F20I/T26M/A47V/E51K/L79P/F91S, P18T/D23A/Q60H/L79P/M90V/F91S/T107M, P18S/D23G/C29R/N35D/E37G/M55I/Q62K/S65A/S67G/R78G/L79P/F91S/L104M/T107M/Q110R, A13E/P18S/M36R/Q62K/S67T/L79P/N85D/F91S/T107M, V9I/P18T/H49R/L79P/N85D/F91S/L104T/T107M, V9A/P18F/T61S/Q62L/L79P/F91S/G111R, D8E/P18T/T61A/L79P/F91S/T107M, P18S/V41A/H49R/S54C/L79S/N85Y/L88P/F91S/L104M/T107M, V11E/P18H/F20Y/V25E/N35S/H49R/L79P/F91S/T107M/G111R, V11A/P18F/D23A/L79P/G80D/V95A/T107M, P18S/K70R/L79P/F91S/G111R, V9L/V11M/P18S/N35S/S54G/Q62K/L79P/L104M/T107M/V115M, V9L/P18Y/V25A/V38G/M55V/A77T/L79P/M90I/F91S/L104M, V10G/P18T/L72Q/L79P/F91S/T107M, P18S/H59R/A76G/R78S/L79P, V9A/P18S/M36T/S65G/L79P/F91S/L104T/G111R/S1121, P18T/S52A/V57A/Q60R/Q62K/S65C/L79P/F91T/N100Y/T107M, V11A/P18F/N35D/A47E/Q62K/L79P/F91S/G99D/T107M/S114N, V11A/P18T/N35S/L79P/S87T/F91S, V9D/V11M/Q12L/P18S/E37V/M55I/Q60R/K70Q/L79P/F91S/L104M/T107M, or T15S/P18S/Y30H/Q32L/Q62R/L79P/F91S/T107M.

In some embodiments, the IRBM is or contains an IgD (e.g. IgV) of a wild-type CD155 polypeptide set forth in Table 4 or a vIgD thereof comprising any of the modifications (e.g. substitutions) listed in Table 4. Table 4 also provides exemplary sequences by reference to SEQ ID NO for IRBMs containing an ECD or IgV domain of CD155. As indicated, the exact locus or residues corresponding to a given domain can vary, such as depending on the methods used to identify or classify the domain. Also, in some cases, adjacent N- and/or C-terminal amino acids of a given domain (e.g. ECD or IgV) also can be included in a sequence of an IRBM, such as to ensure proper folding of the domain when expressed. Thus, it is understood that the exemplification of the SEQ ID NOS in Table 4 is not to be construed as limiting. For example, the particular domain, such as the ECD or IgV domain, can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the IRBM is or contains a wild-type ECD set forth in SEQ ID NO: 47 or a variant ECD sequence set forth in any one of SEQ ID NOS: 311-331, 375-471, 1551-1622. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the ECD sequences set forth in any one of SEQ ID NOS: 311-331, 375-471, 1551-1622 and contains the amino acid modification(s), e.g. substitution(s) not present in the wild-type or unmodified CD155 ECD, e.g. not present in SEQ ID NO:47. In some embodiments, the IRBM is or contains a specific binding fragment of any of the ECD sequences set forth in any one of SEQ ID NOS: 311-331, 375-471, 1551-1622 and that contains the amino acid modification(s), e.g. substitution(s) not present in the wild-type or unmodified CD155 ECD, e.g. not present in SEQ ID NO:47.

In some embodiments, the IRBM is or contains a wild-type CD155 IgV set forth in SEQ ID NO: 310 or 353 or a variant IgV set forth in any one of SEQ ID NOS: 332-352, 354-374, 472-665, 1505-1550, 1575-1576, 1623-1714. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 332-352, 354-374, 472-665, 1505-1550, 1575-1576, 1623-1714 and contains the amino acid modification(s), e.g. substitution(s), not present in the wild-type or unmodified CD155 IgV, e.g. not present in SEQ ID NO: 310 or 353. In some embodiments, the IRBM is or contains a specific binding fragment of any of the IgV sequences set forth in any one of SEQ ID NOS: 332-352, 354-374, 472-665, 1505-1550, 1575-1576, 1623-1714 and that contains the amino acid modification(s), e.g. substitution(s) not present in the wild-type or unmodified CD155 IgV, e.g. not present in SEQ ID NO: 310 or 353.

TABLE 4

Exemplary CD155 IRBMs containing an IgD or vIgD

| Mutation(s) | ECD SEQ ID NO | IgV SEQ ID NO |
|---|---|---|
| Wild-type | 47 | 310, 353 |
| P18S, P64S, F91S | 311 | 332, 354 |
| P18S, F91S, L104P | 312 | 333, 355 |
| L44P | 313 | 334, 356 |
| A56V | 314 | 335, 357 |
| P18L, L79V, F91S | 315 | 336, 358 |
| P18S, F91S | 316 | 337, 359 |
| P18T, F91S | 317 | 338, 360 |
| P18T, S42P, F91S | 318 | 339, 361 |

TABLE 4-continued

| Exemplary CD155 IRBMs containing an IgD or vIgD | | |
|---|---|---|
| Mutation(s) | ECD SEQ ID NO | IgV SEQ ID NO |
| G7E, P18T, Y30C, F91S | 319 | 340, 362 |
| P18T, F91S, G111D | 320 | 341, 363 |
| P18S, F91P | 321 | 342, 364 |
| P18T, F91S, F108L | 322 | 343, 365 |
| P18T, T45A, F91S | 323 | 344, 366 |
| P18T, F91S, R94H | 324 | 345, 367 |
| P18S, Y30C, F91S | 325 | 346, 368 |
| A81V, L83P | 326 | 347, 369 |
| L88P | 327 | 348, 370 |
| R94H | 328 | 349, 371 |
| ABE, P18S, A56V, F91S | 329 | 350, 372 |
| P18T, F91S, V115A | 330 | 351, 373 |
| P18T, Q60K | 331 | 352, 374 |
| S52M | 375 | 472, 569 |
| T45Q, S52L, L104E, G111R | 376 | 473, 570 |
| S42G | 377 | 474, 571 |
| Q62F | 378 | 475, 572 |
| S52Q | 379 | 476, 573 |
| S42A, L104Q, G111R | 380 | 477, 574 |
| S42A, S52Q, L104Q, G111R | 381 | 478, 575 |
| S52W, L104E | 382 | 479, 576 |
| S42C | 383 | 480, 577 |
| S52W | 384 | 481, 578 |
| S52M, L104Q | 385 | 482, 579 |
| S42L, S52L, Q62F, L104Q | 386 | 483, 580 |
| S42W | 387 | 484, 581 |
| S42Q | 388 | 485, 582 |
| S52L | 389 | 486, 583 |
| S52R | 390 | 487, 584 |
| L104E | 391 | 488, 585 |
| G111R | 392 | 489, 586 |
| S52E | 393 | 490, 587 |
| Q62Y | 394 | 491, 588 |
| T45Q, S52M, L104E | 395 | 492, 589 |
| S42N, L104Q, G111R | 396 | 493, 590 |
| S52M, V57L | 397 | 494, 591 |
| S42N, S52Q, Q62F | 398 | 495, 592 |
| S42A, S52L, L104E, G111R | 399 | 496, 593 |
| S42W, S52Q, V57L, Q62Y | 400 | 497, 594 |
| L104Q | 401 | 498, 595 |
| S42L, S52Q, L104E | 402 | 499, 596 |
| S42C, S52L | 403 | 500, 597 |
| S42W, S52R, Q62Y, L104Q | 404 | 501, 598 |
| T45Q, S52R, L104E | 405 | 502, 599 |
| S52R, Q62F, L104Q, G111R | 406 | 503, 600 |
| T45Q, S52L, V57L, L104E | 407 | 504, 601 |
| S52M, Q62Y | 408 | 505, 602 |
| Q62F, L104E, G111R | 409 | 506, 603 |
| T45Q, S52Q | 410 | 507, 604 |
| S52L, L104E | 411 | 508, 605 |
| S42V, S52E | 412 | 509, 606 |
| T45Q, S52R, G111R | 413 | 510, 607 |
| S42G, S52Q, L104E, G111R | 414 | 511, 608 |
| S42N, S52E, V57L, L104E | 415 | 512, 609 |
| S42C, S52M, Q62F | 416 | 513, 610 |
| S42L | 417 | 514, 611 |
| S42A | 418 | 515, 612 |
| S42G, S52L, Q62F, L104Q | 419 | 516, 613 |
| S42N | 420 | 517, 614 |
| P18T, S65A, S67V, F91S | 421 | 518, 615 |
| P18F, T39A, T45Q, T61R, S65N, S67L, E73G, R78G | 422 | 519, 616 |
| P18T, T45Q, T61R, S65N, S67L | 423 | 520, 617 |
| P18F, S65A, S67V, F91S | 424 | 521, 618 |
| P18F, T45Q, T61R, S65N, S67L, F91S, L104P | 425 | 522, 619 |
| P18S, L79P, L104M | 426 | 523, 620 |
| P18S, L104M | 427 | 524, 621 |
| L79P, L104M | 428 | 525, 622 |
| P18T, T45Q, L79P | 429 | 526, 623 |
| P18T, T45Q, T61R, S65H, S67H | 430 | 527, 624 |
| P18T, A81E | 431 | 528, 625 |
| P18S, D23Y, E37P, S52G, Q62M, G80S, A81P, G99Y, S112N | 432 | 529, 626 |
| A13R, D23Y, E37P, S42P, Q62Y, A81E | 433 | 530, 627 |
| A13R, D23Y, E37P, G99Y, S112N | 434 | 531, 628 |
| A13R, D23Y, E37P, Q62M, A77V, G80S, A81P, G99Y | 435 | 532, 629 |

TABLE 4-continued

| Exemplary CD155 IRBMs containing an IgD or vIgD | | |
|---|---|---|
| Mutation(s) | ECD SEQ ID NO | IgV SEQ ID NO |
| P18L, E37S, Q62M, G80S, A81P, G99Y, S112N | 436 | 533, 630 |
| P18S, L104T | 437 | 534, 631 |
| P18S, Q62H, L79Q, F91S | 438 | 535, 632 |
| T45Q, S52K, Q62F, L104Q, G111R | 439 | 536, 633 |
| T45Q, S52Q, Q62Y, L104Q, G111R | 440 | 537, 634 |
| T45Q, S52Q, Q62Y, L104E, G111R | 441 | 538, 635 |
| V57A, T61M, S65W, S67A, E96D, L104T | 442 | 539, 636 |
| P18L, V57T, T61S, S65Y, S67A, L104T | 443 | 540, 637 |
| P18T, T45Q | 444 | 541, 638 |
| P18L, V57A, T61M, S65W, S67A, L104T | 445 | 542, 639 |
| T61M, S65W, S67A, L104T | 446 | 543, 640 |
| P18S, V41A, S42G, T45G, L104N | 447 | 544, 641 |
| P18H, S42G, T45I, S52T, G53R, S54H, V57L, H59E, T61S, S65D, E68G, L104N | 448 | 545, 642 |
| P18S, S42G, T45V, F58L, S67W, L104N | 449 | 546, 643 |
| P18S, T45I, L104N | 450 | 547, 644 |
| P18S, S42G, T45G, L104N, V106A | 451 | 548, 645 |
| P18H, H40R, S42G, T45I, S52T, G53R, S54H, V57L, H59E, T61S, S65D, E68G, L104Y, V106L, F108H | 452 | 549, 646 |
| E37V, S42G, T45G, L104N | 453 | 550, 647 |
| P18S, T45Q, L79P, L104T | 454 | 551, 648 |
| P18L, Q62R | 455 | 552, 649 |
| A13R, D23Y, E37P, S42L, S52G, Q62Y, A81E | 456 | 553, 650 |
| P18L, H49R, L104T, D116N | 457 | 554, 651 |
| A13R, D23Y, E37P, Q62M, G80S, A81P, L104T | 458 | 555, 652 |
| S65T, L104T | 459 | 556, 653 |
| A13R, D23Y, E37P, S52G, V57A, Q62M, K70E, L104T | 460 | 557, 654 |
| P18L, A47V, Q62Y, E73D, L104T | 461 | 558, 655 |
| H40T, V41M, A47V, S52Q, Q62L, S65T, E73R, D97G, E98S, L104T, D116N | 462 | 559, 656 |
| P18L, S42P, T45Q, T61G, S65H, S67E, L104T, D116N | 463 | 560, 657 |
| P18S, H40T, V41M, A47V, S52Q, Q62L, S65T, E73R, L104M, V106A | 464 | 561, 658 |
| H40T, V41M, A47V, S52Q, Q62L, S65T, E68G, E73R, D97G, E98S, L104T | 465 | 562, 659 |
| T45Q, S52E, L104E | 466 | 563, 660 |
| T45Q, S52E, Q62F, L104E | 467 | 564, 661 |
| P18F, T26M, L44V, Q62K, L79P, F91S, L104M, G111D | 468 | 565, 662 |
| P18S, T45S, T61K, S65W, S67A, F91S, G111R | 469 | 566, 663 |
| P18S, L79P, L104M, T107M | 470 | 567, 664 |
| P18S, S65W, S67A, M90V, V95A, L104Q, G111R | 471 | 568, 665 |
| P18S, A47G, L79P, F91S, L104M, T107A, R113W | 1551 | 1505, 1528 |
| P18T, D23G, S24A, N35D, H49L, L79P, F91S, L104M, G111R | 1552 | 1506, 1529 |
| V9L, P18S, Q60R, V75L, L79P, R89K, F91S, L104E, G111R | 1553 | 1507, 1530 |
| P18S, H49R, E73D, L79P, N85D, F91S, V95A, L104M, G111R | 1554 | 1508, 1531 |
| V11A, P18S, L79P, F91S, L104M, G111R | 1555 | 1509, 1532 |
| V11A, P18S, S54R, Q60P, Q62K, L79P, N85D, F91S, T107M | 1556 | 1510, 1533 |
| P18T, S52P, S65A, S67V, L79P, F91S, L104M, G111R | 1557 | 1511, 1534 |
| P18T, M36T, L79P, F91S, G111R | 1558 | 1512, 1535 |
| D8G, P18S, M36I, V38A, H49Q, A76E, F91S, L104M, T107A, R113W | 1559 | 1513, 1536 |
| P18S, S52P, S65A, S67V, L79P, F91S, L104M, T107S, R113W | 1560 | 1514, 1537 |
| T15I, P18T, L79P, F91S, L104M, G111R | 1561 | 1515, 1538 |
| P18F, T26M, L44V, Q62K, L79P, E82D, F91S, L104M, G11 ID | 1562 | 1516, 1539 |
| P18T, E37G, G53R, Q62K, L79P, F91S, E98D, L104M, T107M | 1563 | 1517, 1540 |
| P18L, K70E, L79P, F91S, V95A, G111R | 1564 | 1518, 1541 |
| V9I, Q12K, P18F, S65A, S67V, L79P, L104T, G111R, S1121 | 1565 | 1519, 1542 |
| P18F, S65A, S67V, F91S, L104M, G111R | 1566 | 1520, 1543 |
| V9I, V10I, P18S, F20S, T45A, L79P, F91S, L104M, F108Y, G111R, S112V | 1567 | 1521, 1544 |
| V9L, P18L, L79P, M90I, F91S, T102S, L104M, G111R | 1568 | 1522, 1545 |
| P18C, T26M, L44V, M55I, Q62K, L79P, F91S, L104M, T107M | 1569 | 1523, 1546 |
| V91, P18T, D23G, L79P, F91S, G111R | 1570 | 1524, 1547 |
| P18F, L79P, M90L, F91S, V95A, L104M, G111R | 1571 | 1525, 1548 |
| P18T, M36T, S65A, S67E, L79Q, A81T, F91S, G111R | 1572 | 1526, 1549 |
| V9L, P18T, Q62R, L79P, F91S, L104M, G111R | 1573 | 1527, 1550 |
| P18S, S65W, S67A, L104Q, G111R | 1574 | 1575, 1576 |
| P18T, G19D, M36T, S54N, L79P, L83Q, F91S, T107M, F108Y | 1577 | 1623, 1669 |
| V9L, P18L, M55V, S69L, L79P, A81E, F91S, T107M | 1578 | 1624, 1670 |
| P18F, H40Q, T61K, Q62K, L79P, F91S, L104M, T107V | 1579 | 1625, 1671 |
| P18S, Q32R, Q62K, R78G, L79P, F91S, T107A, R113W | 1580 | 1626, 1672 |
| Q12H, P18T, L21S, G22S, V57A, Q62R, L79P, F91S, T107M | 1581 | 1627, 1673 |
| V9I, P18S, S24P, H49Q, F58Y, Q60R, Q62K, L79P, F91S, T107M | 1582 | 1628, 1674 |
| P18T, W46C, H49R, S65A, S67V, A76T, L79P, S87T, L104M | 1583 | 1629, 1675 |
| P18S, S42T, E51G, L79P, F91S, G92W, T107M | 1584 | 1630, 1676 |
| V10F, T15S, P18L, R48Q, L79P, F91S, T107M, VI15M | 1585 | 1631, 1677 |
| P18S, L21M, Y30F, N35D, R84W, F91S, T107M, D116G | 1586 | 1632, 1678 |
| P18F, E51V, S54G, Q60R, L79Q, E82G, S87T, M90I, F91S, G92R, T107M | 1587 | 1633, 1679 |
| Q16H, P18F, F91S, T107M | 1588 | 1634, 1680 |
| P18T, D23G, Q60R, S67L, L79P, F91S, T107M, V115A | 1589 | 1635, 1681 |

TABLE 4-continued

| Exemplary CD155 IRBMs containing an IgD or vIgD | | |
|---|---|---|
| Mutation(s) | ECD SEQ ID NO | IgV SEQ ID NO |
| D8G, V9I, V11A, P18T, T26M, S52P, L79P, F91S, G92A, T107L, V115A | 1590 | 1636, 1682 |
| V9I, P18F, A47E, G50S, E68G, L79P, F91S, T107M | 1591 | 1637, 1683 |
| P18S, M55I, Q62K, S69P, L79P, F91S, T107M | 1592 | 1638, 1684 |
| P18T, T39S, S52P, S54R, L79P, F91S, T107M | 1593 | 1639, 1685 |
| P18S, D23N, L79P, F91S, T107M, S114N | 1594 | 1640, 1686 |
| P18S, P34S, E51V, L79P, F91S, G111R | 1595 | 1641, 1687 |
| P18S, H59N, V75A, L79P, A81T, F91S, L104M, T107M | 1596 | 1642, 1688 |
| P18S, W46R, E68D, L79P, F91S, T107M, R113G | 1597 | 1643, 1689 |
| V9L, P18F, T45A, S65A, S67V, R78K, L79V, F91S, T107M, S114T | 1598 | 1644, 1690 |
| P18T, M55L, T61R, L79P, F91S, V106I, T107M | 1599 | 1645, 1691 |
| T15I, P18S, V33M, N35F, T39S, M55L, R78S, L79P, F91S, T107M | 1600 | 1646, 1692 |
| P18S, Q62K, K70E, L79P, F91S, G92E, R113W | 1601 | 1647, 1693 |
| P18F, F20I, T26M, A47V, E51K, L79P, F91S | 1602 | 1648, 1694 |
| P18T, D23A, Q60H, L79P, M90V, F91S, T107M | 1603 | 1649, 1695 |
| P18S, D23G, C29R, N35D, E37G, M55I, Q62K, S65A, S67G, R78G, L79P, F91S, L104M, T107M, Q110R | 1604 | 1650, 1696 |
| ABE, P18S, M36R, Q62K, S67T, L79P, N85D, F91S, T107M | 1605 | 1651, 1697 |
| V91, P18T, H49R, L79P, N85D, F91S, L104T, T107M | 1606 | 1652, 1698 |
| V9A, P18F, T61S, Q62L, L79P, F91S, G111R | 1607 | 1653, 1699 |
| D8E, P18T, T61A, L79P, F91S, T107M | 1608 | 1654, 1700 |
| P18S, V41A, H49R, S54C, L79S, N85Y, L88P, F91S, L104M, T107M | 1609 | 1655, 1701 |
| V11E, P18H, F20Y, V25E, N35S, H49R, L79P, F91S, T107M, G111R | 1610 | 1656, 1702 |
| V11A, P18F, D23A, L79P, G80D, V95A, T107M | 1611 | 1657, 1703 |
| P18S, K70R, L79P, F91S, G111R | 1612 | 1658, 1704 |
| V9L, VI1M, P18S, N35S, S54G, Q62K, L79P, L104M, T107M, V115M | 1613 | 1659, 1705 |
| V9L, P18Y, V25A, V38G, M55V, A77T, L79P, M90I, F91S, L104M | 1614 | 1660, 1706 |
| V10G, P18T, L72Q, L79P, F91S, T107M | 1615 | 1661, 1707 |
| P18S, H59R, A76G, R78S, L79P | 1616 | 1662, 1708 |
| V9A, P18S, M36T, S65G, L79P, F91S, L104T, G111R, S1121 | 1617 | 1663, 1709 |
| P18T, S52A, V57A, Q60R, Q62K, S65C, L79P, F91T, N100Y, T107M | 1618 | 1664, 1710 |
| V11A, P18F, N35D, A47E, Q62K, L79P, F91S, G99D, T107M, S114N | 1619 | 1665, 1711 |
| V11A, P18T, N35S, L79P, S87T, F91S | 1620 | 1666, 1712 |
| V9D, VI1M, Q12L, P18S, E37V, M55I, Q60R, K70Q, L79P, F91S, L104M, T107M | 1621 | 1667, 1713 |
| T15S, P18S, Y30H, Q32L, Q62R, L79P, F91S, T107M | 1622 | 1668, 1714 |

b. CD112 IgD or vIgD

Provided herein are immunomodulatory proteins containing an IRBM that is or contains one or more IgD domain, such as an unmodified or wild-type IgD or a vIgD, of CD112. In some embodiments, the IRBM is or contains one or more IgD domain of a wild-type or unmodified CD112, such as a mammalian CD112, e.g. a human CD112. In some embodiments, the IRBM is not the full length sequence of the CD112. In some aspects, the IRBM is a soluble polypeptide, is not membrane-expressed and/or lacks the transmembrane and/or cytoplasmic domain of CD112. In some embodiments, the IRBM only contains an extracellular domain (ECD) or a specific binding fragment thereof containing a IgD or vIgD, such as only contains an IgV domain or an IgC domain or specific binding fragment thereof, or combinations thereof.

In some embodiments, the IRBM is or contains the ECD sequence set forth in SEQ ID NO:48 or is a specific binding fragment thereof. In some embodiments, the IRBM is or contains the IgV sequence set forth in SEQ ID NO: 666 or SEQ ID NO: 761, or is a specific binding fragment thereof.

(SEQ ID NO: 48)
QDVRVQVLPEVRGQLGGTVELPCHLLPPVPGLYISL

VTWQRPDAPANHQNVAAFHPKMGPSFPSPKPGSERL

SFVSAKQSTGQDTEAELQDATLALHGLTVEDEGNYT

CEFATFPKGSVRGMTWLRVIAKPKNQAEAQKVTFSQ

-continued

DPTTVALCISKEGRPPARISWLSSLDWEAKETQVSG

TLAGTVTVTSRFTLVPSGRADGVTVTCKVEHESFEE

PALIPVTLSVRYPPEVSISGYDDNWYLGRTDATLSC

DVRSNPEPTGYDWSTTSGTFPTSAVAQGSQLVIHAV

DSLFNTTFVCTVTNAVGMGRAEQVIFVRETPNTAGA

GATGG (SEQ ID NO: 666)
QDVRVQVLPEVRGQLGGTVELPCHLLPPVPGLYISL

VTWQRPDAPANHQNVAAFHPKMGPSFPSPKPGSERL

SFVSAKQSTGQDTEAELQDATLALHGLTVEDEGNYT

CEFATFPKGSVRGMTWL (SEQ ID NO: 761)
QDVRVQVLPEVRGQLGGTVELPCHLLPPVPGLYISL

VTWQRPDAPANHQNVAAFHPKMGPSFPSPKPGSERL

SFVSAKQSTGQDTEAELQDATLALHGLTVEDEGNYT

CEFATFPKGSVRGMTWLRV

In some embodiments, the immunomodulatory protein contains an IRBM that is or contains a vIgD containing one or more amino acid modifications, e.g. substitutions, in an IgD of a wild-type or unmodified CD112. In some embodiments, modifications provided herein can be in an IRBM containing an unmodified IgD set forth in SEQ ID NO:48, 666 or 761 or in a sequence that has 85%, 85%, 87%, 88%, 89%, 90%, 91%, 92%, 93%, 94%, 95%, 96%, 97%, 98%, 99% or more sequence identity to SEQ ID NO: 48, 666 or 761. In some embodiments, an IRBM containing a vIgD of CD112 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 48, 666 or 761.

In some embodiments, the vIgD is an affinity-modified IgSF domain that has an increased binding activity, such as binding affinity, for TIGIT relative to the binding affinity of the wild-type or unmodified IgD for TIGIT. In some embodiments, the increase in binding activity, e.g. binding affinity, for TIGIT is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions). In some embodiments, the equilibrium dissociation constant ($K_d$) of the IRBM to TIGIT can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less.

In some aspects, a vIgD of CD112 may exhibit increased binding activity, e.g. binding affinity, to the activating receptor CD226. In some embodiments, the increase in binding activity, e.g. binding affinity, for TIGIT is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, such a vIgD may be used as an ARBM in the embodiments provided herein. In some embodiments, the equilibrium dissociation constant ($K_d$) of the ARBM to CD226 can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less. In some embodiments, such an ARBM exhibits a greater binding activity, e.g. binding affinity, for CD226 than for TIGIT, such as a binding activity, e.g. binding affinity, that is at least 1.2-fold, 1.5-fold, 2.0-fold, 3.0-fold, 4.0-fold, 5.0-fold or 10.0-fold greater for CD226 than for TIGIT.

Unless stated otherwise, the amino acid modification(s) present in a vIgD of a CD112 ECD or an IgD (e.g. IgV) thereof are designated by amino acid position number corresponding to the numbering of positions of the unmodified ECD sequence set forth in SEQ ID NO:48 or, where applicable, the unmodified IgV sequence set forth in SEQ ID NO: 666 or 761. It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs:48, 666 or 761. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the IRBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified CD112. In some embodiments, the one or more amino acid modifications, e.g. substitutions, are in the ECD domain of CD112 or a specific binding fragment thereof. In some embodiments, the one or more amino acid modifications, e.g. substitutions, are in the IgV domain of CD112 or a specific binding fragment thereof. In some embodiments, the one or more amino acid modifications, e.g. substitutions, are in an IgC domain of CD112 or a specific binding fragment thereof. In some embodiments, the one or more amino acid modifications, e.g. substitutions, are in the IgV domain of CD112 or a specific binding fragment thereof and in an IgC domain or domains of CD112 or a specific binding fragment thereof.

In some embodiments, the IRBM is or contains a vIgD that has one or more amino acid modifications, e.g., substitutions in an unmodified IgD of CD112 or specific binding fragment there of corresponding to position(s) 9, 12, 15, 18, 19, 21, 22, 24, 27, 28, 29, 32, 30, 32, 33, 34, 35, 37, 38, 40, 42, 43, 45, 46, 47, 48, 51, 54, 56, 60, 64, 66, 67, 69, 74, 75, 76, 78, 79, 80, 81, 82, 83, 84, 85, 87, 90, 95, 96, 98, 99, 100, 101, 106, 108, 110, 111, 112, 113, 114, 115, 116, 117, 118, 119, 121, 122, 124, or 125 with reference to positions set forth in SEQ ID NO: 48, 666 or 761. In some embodiments, a polypeptide containing the vIgD exhibits altered, such as increased, binding activity, e.g. binding affinity, to TIGIT compared toa polypeptide containing the wild-type or unmodified CD112 IgD.

In some embodiments, the IRBM is or contains a vIgD of CD112 that has one or more amino acid modification selected from P9R, P9S, R12W, L15V, T18S, T18A, V19A, L21V, P22L, H24R, P27A, P27L, P27S, P28S, V29M, V29A, P30S, L32P, Y33H, I34M, S35P, V37M, T38A, T38N, Q40R, P42L, P42S, D43G, P45S, A46T, N47K, N47S, H48Y, V51M, F54L, F54S, P56L, P60T, S64G, K66M, P67H, P67S, S69F, S69P, F74L, F74S, V75M, S76P, K78R, Q79R, S80G, T81I, T81S, G82S, Q83K, D84G, T85A, A87V, Q90R, A95T, A95V, L96P, G98D, G98S, L99M, T100A, V101A, V101M, N106I, N106Y, T108A, T1081, E110G, F111L, A112I, A112V, T113A, T113S, F114L, F114S, F114Y, P115S, K116E, G117D, S118F, S118T, S118Y, V119A, G121S, M1221, W124L, or L125A, or a conservative amino acid substitution thereof.

In some embodiments, the IRBM is or contains a vIgD that has two or more amino acid modification selected from P9R, P9S, R12W, L15V, T18S, T18A, V19A, L21V, P22L, H24R, P27A, P27L, P27S, P28S, V29M, V29A, P30S, L32P, Y33H, I34M, S35P, V37M, T38A, T38N, Q40R, P42L, P42S, D43G, P45S, A46T, N47K, N47S, H48Y, V51M, F54L, F54S, P56L, P60T, S64G, K66M, P67H, P67S, S69F, S69P, F74L, F74S, V75M, S76P, K78R, Q79R, S80G, T81I, T81S, G82S, Q83K, D84G, T85A, A87V, Q90R, A95T, A95V, L96P, G98D, G98S, L99M, T100A, V101A, V101M, N106I, N106Y, T108A, T1081, E110G, F111L, A112I, A112V, T113A, T113S, F114L, F114S, F114Y, P115S, K116E, G117D, S118F, S118T, S118Y, V119A, G121S, M1221, W124L, or L125A.

In some embodiments, the two or more amino acid modification(s), e.g. substitution(s), is Y33H/A112V/

G117D, V19A/Y33H/S64G/S80G/G98S/N106Y/A112V, L32P/A112V, A95V/A112I, P28S/A112V, P27A/T38N/V101A/A112V, R12W/H48Y/F54S/S118F, R12W/Q79R/S118F, T113S/S118Y, N106I/S118Y, N106I/S118F, A95T/L96P/S118Y, Y33H/P67S/N106Y/A112V, N106Y/A112V, T18S/Y33H/A112V, P9S/Y33H/N47S/A112V, P42S/P67H/A112V, P27L/L32P/P42S/A112V, G98D/A112V, Y33H/S35P/N106Y/A112V, L32P/P42S/T100A/A112V, P27S/P45S/N106I/A112V, Y33H/N47K/A112V, Y33H/N106Y/A112V, K78R/D84G/A112V/F114S, Y33H/N47K/F54L/A112V, Y33H/A112V, A95V/A112V, R12W/A112V, R12W/P27S/A112V, Y33H/V51M/A112V, Y33H/A112V/S118T, Y33H/V101A/A112V/P115S, H24R/T38N/D43G/A112V, P27A/A112V, A112V/S118T, R12W/A112V/M1221, Q83K/N106Y/A112V, R12W/P27S/A112V/S118T, P28S/Y33H/A112V, P27S/Q90R/A112V, L15V/P27A/A112V/S118T, Y33H/N106Y/T108I/A112V, Y33H/P56L/V75M/V101M/A112V, N47K/Q79R/S118F, Q40R/P60T/A112V/S118T, F114Y/S118F, Y33H/K78R/S118Y, R12W/A46T/K66M/Q79R/N106I/T113A/S118F, Y33H/A112V/S118F, R12W/Y33H/N106I/S118F, L15V/Q90R/S118F, N47K/D84G/N106I/S118Y, L32P/S118F, Y33H/Q79R/A112V/S118Y, T18A/N106I/S118T, L15V/Y33H/N106Y/A112V/S118F, V37M/S118F, N47K/A112V/S118Y, A46T/A112V, P28S/Y33H/N106I/S118Y, P30S/Y33H/N47K/V75M/Q79R/N106I/S118Y, V19A/N47K/N106Y/K116E/S118Y, Q79R/T85A/A112V/S118Y, V101M/N106I/S118Y, Y33H/Q79R/N106I/A112V/S118T, Q79R/A112V, Y33H/A46T/Q79R/N106I/S118F, A112V/G121S, Y33H/Q79R/N106I/S118Y, Y33H/N106I/A112V, Y33H/A46T/V101M/A112V/S118T, L32P/L99M/N106I/S118F, L32P/T108A/S118F, R12W/Q79R/A112V, Y33H/N106Y/E110G/A112V, Y33H/N106I/S118Y, Q79R/S118F, Y33H/Q79R/G98D/V101M/A112V, N47K/T81S/V101M/A112V/S118F, G82S/S118Y, Y33H/A112V/S118Y, Y33H/N47K/Q79R/N106Y/A112V, Y33H/S118T, R12W/Y33H/Q79R/V101M/A112V, Y33H/Q83K/A112V/S118T, V29M/Y33H/N106I/S118F, Y33H/A46T/A112V, Y33H/Q79R/S118F, Y33H/N47K/F74L/S118F, R12W/V101M/N106I/S118Y, A46T/V101A/N106I/S118Y, N106Y/A112V/S118T, S76P/T81I/V101M/N106Y/A112V/S118F, P9R/L21V/P22L/I34M/S69F/F74L/A87V/A112V/L125A, Y33H/V101M/A112V, V29A/L32P/S118F, Y33H/V101M/N106I/A112V, R12W/Y33H/N47K/Q79R/S118Y, Y33H/A46T/A112V/S118T, Y33H/A112V/F114L/S118T, Y33H/T38A/A46TN101M/A112V, P28S/Y33H/S69P/N106I/A112V/S118Y, Y33H/P42L/N47K/V101M/A112V, Y33H/N47K/F74S/Q83K/N106I/F111L/A112V/S118T, Y33H/A112V/S118T/V119A, Y33H/N106I/A112V/S118F, Y33H/K66M/S118F/W124L, or N106I/A112V.

In some embodiments, the IRBM is or contains an IgD (e.g. IgV) of a wild-type CD112 polypeptide set forth in Table 5 or a vIgD thereof that comprises any of the modifications, e.g., substitutions, listed in Table 5. Table 5 also provides exemplary sequences by reference to SEQ ID NO for IRBMs containing an ECD or IgV domain of CD112. As indicated, the exact locus or residues corresponding to a given domain can vary, such as depending on the methods used to identify or classify the domain. Also, in some cases, adjacent N- and/or C-terminal amino acids of a given domain (e.g., ECD or IgV) also can be included in a sequence of a variant IgSF polypeptide, such as to ensure proper folding of the domain when expressed. Thus, it is understood that the exemplification of the SEQ ID NOS in Table 5 is not to be construed as limiting. For example, the particular domain, such as the ECD or IgV domain, can be several amino acids longer or shorter, such as 1-10, e.g., 1, 2, 3, 4, 5, 6 or 7 amino acids longer or shorter, than the sequence of amino acids set forth in the respective SEQ ID NO.

In some embodiments, the IRBM is or contains a wild-type ECD set forth in SEQ ID NO: 48 or a variant ECD set forth in any one of SEQ ID NOS:667-713, 809-849, 1433-1456. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the ECD sequences set forth in any one of SEQ ID NOS: 667-713, 809-849, 1433-1456 and contains the amino acid modification, e.g., substitution(s) not present in the wild-type or unmodified CD112 ECD, e.g. not present in SEQ ID NO:48. In some embodiments, the IRBM is or contains a specific binding fragment of any of the ECD sequences set forth in any one of SEQ ID NOS: 667-713, 809-849, 1433-1456 and that contains the amino acid modification, e.g., substitution(s) not present in the wild-type or unmodified CD112 ECD, e.g. not present in SEQ ID NO:48.

In some embodiments, the IRBM is or contains a wild-type CD112 IgV set forth in SEQ ID NO: 666 or 761 or a variant IgV set forth in any one of SEQ ID NOS: 714-760, 762-808, 850-931, 1457-1504. In some embodiments, the IRBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 714-760, 762-808, 850-931, 1457-1504 and contains the amino acid modification, e.g., substitution (s) not present in the wild-type or unmodified CD112 IgV, e.g. not present in SEQ ID NO:666 or 761. In some embodiments, the IRBM is or comprises a specific binding fragment of any of the IgV sequences set forth in any one of SEQ ID NOS: 714-760, 762-808, 850-931, 1457-1504 and that contains the amino acid modification, e.g., substitution (s), not present in the wild-type or unmodified CD112 IgV, e.g. not present in SEQ ID NO:666 or 761.

TABLE 5

Exemplary variant CD112 IRBMs containing an IgD or vIgD

| Mutation(s) | ECD SEQ ID NO | IgV SEQ ID NO |
|---|---|---|
| Wild-type | 48 | 666, 761 |
| Y33H, A112V, G117D | 667 | 714, 762 |
| V19A, Y33H, S64G, S80G, G98S, N106Y, A112V | 668 | 715, 763 |
| L32P, A112V | 669 | 716, 764 |
| A95V, A1121 | 670 | 717, 765 |
| P28S, A112V | 671 | 718, 766 |

TABLE 5-continued

| Exemplary variant CD112 IRBMs containing an IgD or vIgD | | |
|---|---|---|
| Mutation(s) | ECD SEQ ID NO | IgV SEQ ID NO |
| P27A, T38N, V101A, A112V | 672 | 719, 767 |
| S118F | 673 | 720, 768 |
| R12W, H48Y, F54S, S118F | 674 | 721, 769 |
| R12W, Q79R, S118F | 675 | 722, 770 |
| T113S, S118Y | 676 | 723, 771 |
| S118Y | 677 | 724, 772 |
| N106I, S118Y | 678 | 725, 773 |
| N106I, S118F | 679 | 726, 774 |
| A95T, L96P, S118Y | 680 | 727, 775 |
| Y33H, P67S, N106Y, A112V | 681 | 728, 776 |
| N106Y, A112V | 682 | 729, 777 |
| T18S, Y33H, A112V | 683 | 730, 778 |
| P9S, Y33H, N47S, A112V | 684 | 731, 779 |
| P42S, P67H, A112V | 685 | 732, 780 |
| P27L, L32P, P42S, A112V | 686 | 733, 781 |
| G98D, A112V | 687 | 734, 782 |
| Y33H, S35P, N106Y, A112V | 688 | 735, 783 |
| L32P, P42S, T100A, A112V | 689 | 736, 784 |
| P27S, P45S, N106I, A112V | 690 | 737, 785 |
| Y33H, N47K, A112V | 691 | 738, 786 |
| Y33H, N106Y, A112V | 692 | 739, 787 |
| K78R, D84G, A112V, Fl 14S | 693 | 740, 788 |
| Y33H, N47K, F54L, A112V | 694 | 741, 789 |
| Y33H, A112V | 695 | 742, 790 |
| A95V, A112V | 696 | 743, 791 |
| R12W, A112V | 697 | 744, 792 |
| R12W, P27S, A112V | 698 | 745, 793 |
| Y33H, V51M, A112V | 699 | 746, 794 |
| Y33H, A112V, S118T | 700 | 747, 795 |
| Y33H, V101A, A112V, P115S | 701 | 748, 796 |
| H24R, T38N, D43G, A112V | 702 | 749, 797 |
| A112V | 703 | 750, 798 |
| P27A, A112V | 704 | 751, 799 |
| A112V, S118T | 705 | 752, 800 |
| R12W, A112V, M122I | 706 | 753, 801 |
| Q83K, N106Y, A112V | 707 | 754, 802 |
| R12W, P27S, A112V, S118T | 708 | 755, 803 |
| P28S, Y33H, A112V | 709 | 756, 804 |
| P27S, Q90R, A112V | 710 | 757, 805 |
| L15V, P27A, A112V, S118T | 711 | 758, 806 |
| Y33H, N106Y, T108I, A112V | 712 | 759, 807 |
| Y33H, P56L, V75M, V101M, A112V | 713 | 760, 808 |
| N47K, Q79R, S118F | 809 | 850, 891 |
| Q40R, P60T, A112V, S118T | 810 | 851, 892 |
| F114Y, S118F | 811 | 852, 893 |
| Y33H, K78R, S118Y | 812 | 853, 894 |
| R12W, A46T, K66M, Q79R, N106I, T113A, S118F | 813 | 854, 895 |
| Y33H, A112V, S118F | 814 | 855, 896 |
| R12W, Y33H, N106I, S118F | 815 | 856, 897 |
| L15V, Q90R, S118F | 816 | 857, 898 |
| N47K, D84G, N106I, S118Y | 817 | 858, 899 |
| L32P, S118F | 818 | 859, 900 |
| Y33H, Q79R, A112V, S118Y | 819 | 860, 901 |
| T18A, N106I, S118T | 820 | 861, 902 |
| L15V, Y33H, N106Y, A112V, S118F | 821 | 862, 903 |
| V37M, S118F | 822 | 863, 904 |
| N47K, A112V, S118Y | 823 | 864, 905 |
| A46T, A112V | 824 | 865, 906 |
| P28S, Y33H, N106I, S118Y | 825 | 866, 907 |
| P30S, Y33H, N47K, V75M, Q79R, N106I, S118Y | 826 | 867, 908 |
| V19A, N47K, N106Y, K116E, S118Y | 827 | 868, 909 |
| Q79R, T85A, A112V, S118Y | 828 | 869, 910 |
| V101M, N106I, S118Y | 829 | 870, 911 |
| Y33H, Q79R, N106I, A112V, S118T | 830 | 871, 912 |
| Q79R, A112V | 831 | 872, 913 |
| Y33H, A46T, Q79R, N106I, S118F | 832 | 873, 914 |
| A112V, G121S | 833 | 874, 915 |
| Y33H, Q79R, N106I, S118Y | 834 | 875, 916 |
| Y33H, N106I, A112V | 835 | 876, 917 |
| Y33H, A46T, V101M, A112V, S118T | 836 | 877, 918 |
| L32P, L99M, N106I, S118F | 837 | 878, 919 |
| L32P, T108A, S118F | 838 | 879, 920 |
| R12W, Q79R, A112V | 839 | 880, 921 |
| Y33H, N106Y, E110G, A112V | 840 | 881, 922 |

TABLE 5-continued

| Exemplary variant CD112 IRBMs containing an IgD or vIgD | | |
|---|---|---|
| Mutation(s) | ECD SEQ ID NO | IgV SEQ ID NO |
| Y33H, N106I, S118Y | 841 | 882, 923 |
| Q79R, S118F | 842 | 883, 924 |
| Y33H, Q79R, G98D, V101M, A112V | 843 | 884, 925 |
| N47K, T81S, V101M, A112V, S118F | 844 | 885, 926 |
| G82S, S118Y | 845 | 886, 927 |
| Y33H, A112V, S118Y | 846 | 887, 928 |
| Y33H, N47K, Q79R, N106Y, A112V | 847 | 888, 929 |
| Y33H, S118T | 848 | 889, 930 |
| R12W, Y33H, Q79R, V101M, A112V | 849 | 890, 931 |
| Y33H, Q83K, A112V, S118T | 1433 | 1457, 1481 |
| V29M, Y33H, N106I, S118F | 1434 | 1458, 1482 |
| Y33H, A46T, A112V | 1435 | 1459, 1483 |
| Y33H, Q79R, S118F | 1436 | 1460, 1484 |
| Y33H, N47K, F74L, S118F | 1437 | 1461, 1485 |
| R12W, V101M, N106I, S118Y | 1438 | 1462, 1486 |
| A46T, V101A, N106I, S118Y | 1439 | 1463, 1487 |
| N106Y, A112V, S118T | 1440 | 1464, 1488 |
| S76P, T811, V101M, N106Y, A112V, S118F | 1441 | 1465, 1489 |
| P9R, L21V, P22L, I34M, S69F, F74L, A87V, A112V, L125A | 1442 | 1466, 1490 |
| Y33H, V101M, A112V | 1443 | 1467, 1491 |
| V29A, L32P, S118F | 1444 | 1468, 1492 |
| Y33H, V101M, N106I, A112V | 1445 | 1469, 1493 |
| R12W, Y33H, N47K, Q79R, S118Y | 1446 | 1470, 1494 |
| Y33H, A46T, A112V, S118T | 1447 | 1471, 1495 |
| Y33H, A112V, F114L, S118T | 1448 | 1472, 1496 |
| Y33H, T38A, A46T, V101M, A112V | 1449 | 1473, 1497 |
| P28S, Y33H, S69P, N106I, A112V, S118Y | 1450 | 1474, 1498 |
| Y33H, P42L, N47K, V101M, A112V | 1451 | 1475, 1499 |
| Y33H, N47K, F74S, Q83K, N106I, F111L, A112V, S118T | 1452 | 1476, 1500 |
| Y33H, A112V, S118T, VI19A | 1453 | 1477, 1501 |
| Y33H, N106I, A112V, S118F | 1454 | 1478, 1502 |
| Y33H, K66M, S118F, W124L | 1455 | 1479, 1503 |
| N106I, A112V | 1456 | 1480, 1504 |

3. CTLA-4 Binding Molecule

Provided herein are immunomodulatory proteins containing an IRBM that is or contains a binding molecule that binds to CTLA-4, such as to human CTLA-4. CTLA-4, is an inhibitory IgSF receptor that inhibits T cell responses through modulation of TCR/CD28 signaling. CTLA-4 is expressed on T cells, and particularly is expressed following T cell activation. CTLA-4, a co-inhibitory receptor, competes with CD28 for binding of CD80 and CD86 to induce negative regulation of T cell activation. When CTLA-4 binds CD80 and/or CD86 T cell activation and effector function can be eliminated or attenuated. In some embodiments, the IRBM of the immunomodulatory protein binds to the ectodomain of CTLA-4. In some embodiments, the IRBM binds to CTLA-4 on the surface of a cell, such as on the surface of a T cell.

In some embodiments, the provided immunomodulatory protein contains an IRBM that is or contains an antibody that binds CTLA-4 or is an antigen-binding antibody fragment thereof (e.g. Fab or scFv). In some embodiments, the antibody or antigen-binding antibody fragment binds human CTLA-4. For example, in some embodiments, the antibody is ipilimumab or tremelimumab or an antigen binding fragment containing a VH chain region and/or VL chain region of ipilimumab or tremelimumab. In some embodiments, the antibody is a single chain variable fragment (e.g. scFv) containing a VH and VL of ipilimumab or tremelimumab.

In some embodiments, the IRBM is or contains one or more IgD (e.g. IgV or IgC) or a specific binding fragment thereof, such as an unmodified or wild-type IgD or a vIgD or a specific binding fragment thereof, of an IgSF family member that binds CTLA-4. In some embodiments, the CTLA-4 is human CTLA-4. In some embodiments, the IRBM is or contains one or more IgD (e.g. IgV or IgC) that is a vIgD containing one or more amino acid modifications (e.g., substitutions, deletions or additions) compared to an IgD of a wild-type or unmodified CD80 or CD86, which, in some aspects, result in increased binding to CTLA-4 and/or decreased binding to CD28. In some embodiments, the IRBM is or contains a vIgD polypeptide that exhibit increased binding activity, such as binding affinity, for CTLA-4 and decreased binding to CD28 compared to a corresponding wild-type or unmodified IgD of CD80 or CD86. In some embodiments, the IRBM binds to CTLA-4 with an equilibrium dissociation constant ($K_d$) of less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less and does not substantially bind to CD28, such as exhibits a $K_d$ for binding CD28 of greater than or greater than about $1\times10^{-5}$ M, $1\times10^{-4}$ M, $1\times10^{-3}$M or more.

B. Activating Receptor Binding Molecule (ARBM)

In some embodiments, the provided immunomodulatory protein contains an ARBM that binds to an activating receptor or a ligand of an activating receptor. In some embodiments, the activating receptor is expressed on a T cell, such as a human T cell. In some embodiments, the ligand of an activating receptor is expressed on an APC, such as a dendritic cell.

In some aspects, the activating receptor comprises a cytoplasmic region containing an immunoreceptor tyrosine-based activation motif (ITAM) or a cytoplasmic region that interacts with one or more adaptor protein involved in a signal transduction pathway in a cell to induce, mediate or potentiate activation of an immune cell, such as a T cell. In some embodiment, the adaptor protein contains a binding domain specific to a phosphotyrosine residue in a cytoplasmic region of an activating receptor. In some embodiments, the activating receptor includes a component of a TCR complex or is a co-receptor or costimulatory molecule that augments or enhances TCR signaling. In some embodiments, the activating receptor is a TCR, CD3, CD4, CD8, CD28, ICOS or CD2, including any mammalian orthologs thereof. In some embodiments, the activating receptor target is a human TCR, human CD3, human CD4, human CD8, human CD28, human ICOS or human CD2. In some embodiments, the activating receptor is expressed on a T cell, such as a human T cell.

In some cases, the ARBM binds to a ligand of an activating receptor. In some embodiments, the ARBM binds to a ligand of a component of a TCR complex or a ligand of a co-receptor or costimulatory molecule that augments or enhances TCR signaling. In some embodiments, the ARBM binds to a ligand of a TCR, CD3, CD4, CD8, CD28, ICOS or CD2 molecule, including such molecules expressed on a T cell, e.g. a human T cell. In some embodiments, the ARBM binds to a ligand of CD28, such as a ligand of CD28 expressed on a T cell, e.g. a human T cell. In some embodiments, the ligand is a CD80 or a CD86, such as a human CD80 or human CD86. In some embodiments, the ARBM binds to a ligand of a CD4, a CD8 or a TCR, including such molecules expressed on a T cell, e.g. a human T cell. In some embodiments, the ligand is an MHC molecule, such as an MHC class I molecule or an MHC class II molecule. In some embodiments, the ligand is expressed on an APC.

In some embodiments, the ARBM is an antibody or antigen-binding fragment that binds to an activating receptor or binds to a ligand of an activating receptor. In some embodiments, the ARBM is an antibody or antigen-binding fragment that binds to a TCR, CD3, CD4, CD8, CD28, ICOS or CD2, including any mammalian orthologs thereof. In some embodiments, the antibody or antigen-binding fragment binds to a human TCR, human CD3, human CD4, human CD8, human CD28, human ICOS or human CD2, including such molecules expressed on a human T cell. In some embodiments, the antibody or antigen-binding fragment binds to CD80, CD86 or an MHC molecule (e.g. MHC class I or MHC class II). In some embodiments, the antibody or antigen-binding fragment binds to a human CD80, human CD86 or a human MHC molecule, including such molecules expressed on a human APC.

In some embodiments, the ARBM is a binding molecule that binds to CD4 or CD8. In some embodiments, the ARBM is a chemokine or cytokine. In some embodiments, the binding molecule is an IL-16 molecule, which is a chemoattractant that binds to CD4.

In some embodiments, the ARBM is or contains a binding partner of an activating receptor or a ligand of an activating receptor. In some aspects, the ARBM is or contains an IgD of an IgSF family member that binds to an activating receptor, such as binds to TCR, CD3, CD4, CD8, CD28, ICOS or CD2, or is a specific fragment or vIgD thereof that binds to the activating receptor. Exemplary IgSF family members that are binding partners of or that bind to a CD28 activating receptor include, for example, CD80, CD86 and ICOSL, such as human CD80, CD86 or ICOSL. Exemplary IgSF family members that are binding partners of or that bind to CD2 include, for example, LFA-3 (CD58) or CD48, such as human LFA-3 or human CD48. In some embodiments, the IgSF binding partner of an activating receptor is a molecule set forth in Table 6A. In some examples, the ARBM is or contains an IgD of a wild-type CD80, CD86 or ICOSL or is or contains a vIgD thereof, wherein the ARBM specifically binds to CD28. In other examples, the ARBM is or contains an IgD of LFA-3 or CD48 or is or contains a vIgD thereof, wherein the IRBM specifically binds to CD2.

In other aspects, the ARBM is or contains an IgD of an IgSF family member that binds to a ligand of an activating receptor, such as binds to CD80, CD86 or an MHC molecule, or is a specific fragment or vIgD thereof that binds to the ligand of the activating receptor. Exemplary IgSF family members that are binding partners of or that bind to CD80 or CD86 include, for example, CTLA-4, such as human CTLA-4. Exemplary IgSF family members that are binding partners of or that bind to an MHC molecule include, for example, a TCR, CD4, CD8 or LAG-3, such as a human TCR, human CD4, human CD8 or human LAG-3 In some embodiments, the IgSF binding partner of a ligand of an activating receptor is a molecule set forth in Table 6B. In some examples, the ARBM is or contains an IgD of a wild-type CTLA-4 or is or contains a vIgD thereof, wherein the ARBM specifically binds to CD80 or CD86. In other examples, the ARBM is or contains an IgD of a CD4 or CD8 or is or contains a vIgD thereof, wherein the IRBM specifically binds to an MHC molecule.

The first column of Tables 6A and 6B provides the name and, optionally, the name of some possible synonyms for that particular domain. The second column provides the protein identifier of the UniProtKB database, a publicly available database accessible via the internet at uniprot.org. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). The third column provides the region where the indicated IgSF domain is located. The region is specified as a range where the domain is inclusive of the residues defining the range. Column 3 also indicates the domain class for the specified region. Column 4 provides the region where the indicated additional domains are located (signal peptide, S; extracellular domain, E; transmembrane domain, T; cytoplasmic domain, C). Column 5 indicates for some of the listed IgSF members, some of its cognate cell surface binding partners. It is understood that reference to amino acids, including to a specific sequence set forth as a SEQ ID NO used to describe domain organization, such as of an IgSF domain, are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three, four, five, six or more amino acids) longer or shorter.

TABLE 6A

Exemplary IgSF asActivating Receptor Binding Molecules (ARBM): Targeting Activating Receptor (Cis)

| IgSF Member (Synonyms) | NCBI Protein Accession Number/ UniProtKB Protein Identifier | IgSF Region & Domain | Other Domains | Cognate Cell Surface Binding Partners | IgSF Member Amino Acid Sequence (SEQ ID NO) Precursor (mature residues) | Mature | ECD |
|---|---|---|---|---|---|---|---|
| CD80 (B7-1) | NP_005182.1 P33681 | IgV: 35-135, 35-138,37-138, or 35-141 IgC: 145-230 or 154-232 | S: 1-34, E: 35-242, T: 243-263, C: 264-288 | CD28, CTLA4, PD-L1 | SEQ ID NO: 1 (35-288) | SEQ ID NO: 189 | SEQ ID NO: 28 |
| CD86 (B7-2) | P42081.2 | IgV: 33-131 IgC2:150-225 | S: 1-23, E: 24-247, T: 248-268, C: 269-329 | CD28, CTLA4 | SEQ ID NO: 2 (24-329) | SEQ ID NO: 190 | SEQ ID NO: 29 |
| ICOSLG (B7RP1, CD275, ICOSL, B7-H2) | O75144.2 | IgV: 19-129 IgC2: 141-227 | S: 1-18, E: 19-256, T: 257-277, C: 278-302 | ICOS, CD28, CTLA4 | SEQ ID NO: 5 (19-302) | SEQ ID NO: 193 | SEQ ID NO: 32 |
| LFA-3 (CD58) | P19256 | Ig-like: 30-121 | S: 1-28, E: 29-215, T 216-238, C: 239-250 | CD2 | SEQ ID NO: 3237 (29-250) | SEQ ID NO: 3238 | SEQ ID NO: 3239 |
| CD48 | P09326 | Ig-like C2 type 1: 29-127 Ig-like C2 type 1: 132-212 | S: 1-26, Mature: 27-220 GPI anchor: 221-243 | CD2 | SEQ ID NO: 3494 (27-220) | SEQ ID NO: 3493 | |

TABLE 6B

Exemplary IgSF asActivating Receptor Binding Molecules (ARBM): Targeting Ligand of Activating Receptor (Trans)

| IgSF Member (Synonyms) | NCBI Protein Accession Number/ UniProtKB Protein Identifier | IgSF Region & Domain | Other Domains | Cognate Cell Surface Binding Partners | IgSF Member Amino Acid Sequence (SEQ ID NO) Precursor (mature residues) | Mature | ECD |
|---|---|---|---|---|---|---|---|
| CTLA4 | P16410.3 | IgV: 39-140 | S: 1-35, E: 36-161, T: 162-182, C: 183-223 | B7-1, B7-2, B7RP1 | SEQ ID NO: 9 (36-223) | SEQ ID NO: 197 | SEQ ID NO: 36 |
| CD4 | P01730.1 | IgV: 26-125 IgC2: 126-203 IgC2: 204-317 IgC2: 317-389 IgC2: 318-374 | S: 1-25, E: 26-396, T: 397-418, C: 419-458 | MHC class II | SEQ ID NO: 13 (26-458) | SEQ ID NO: 201 | SEQ ID NO: 40 |
| CD8A (CD8-alpha) | P01732.1 | IgV: 22-135 | S: 1-21, E: 22-182, T: 183-203, C: 204-235 | MHC class I | SEQ ID NO: 14 (22-235) | SEQ ID NO: 394 | SEQ ID NO: 41 |
| CD8B (CD8-beta) | P10966.1 | IgV: 22-132 | S: 1-21, E: 22-170, T: 171-191, C: 192-210 | MHC class I | SEQ ID NO: 15 (22-210) | SEQ ID NO: 395 | SEQ ID NO: 42 |

TABLE 6B-continued

Exemplary IgSF asActivating Receptor Binding Molecules (ARBM): Targeting Ligand of Activating Receptor (Trans)

| IgSF Member (Synonyms) | NCBI Protein Accession Number/ UniProtKB Protein Identifier | IgSF Region & Domain | Other Domains | Cognate Cell Surface Binding Partners | IgSF Member Amino Acid Sequence (SEQ ID NO) Precursor (mature residues) | Mature | ECD |
|---|---|---|---|---|---|---|---|
| LAG3 | P18627.5 | 37-167 IgV, 168-252 IgC2, 265-343 IgC2, 349-419 IgC2 | S: 1-28, E: 29-450, T: 451-471, C: 472-525 | MHC class II | SEQ ID NO: 16 (29-525) | SEQ ID NO: 204 | SEQ ID NO: 43 |

In some embodiments, the ARBM is or contains a wild-type or unmodified IgD of a binding partner of an activating receptor or a ligand of an activating receptor, such as a sequence that is or contains an ECD or an IgD domain or domains of a native binding partner of an inhibitory receptor or an ortholog thereof. In some embodiments, the ARBM is or comprises the extracellular domain (ECD), or a portion thereof containing one or more IgSF domains, of an IgSF member set forth in Table 6A, e.g. human CD80, human CD86, human ICOSL, human LFA-3 (CD58) or human CD48. In some embodiments, the ARBM is or comprises the extracellular domain (ECD), or a portion thereof containing one or more IgSF domains, of an IgSF member set forth in Table 6B, e.g. human CTLA-4, human CD4, human CD8a, human CD8b or human LAGS. In some embodiments, the extracellular domain comprises an IgV domain or domains and, in some cases, an IgC (e.g. IgC1 and/or IgC2) domain or domains. In some embodiments, the ARBM is less than the full length sequence of the IgSF binding partner of the activating receptor or a ligand of the activating receptor. For example, in some aspects, the ARBM is or only contains the extracellular domain (ECD) or specific binding fragment thereof of the binding partner. In some embodiments, the ARBM is or only contains the IgV domain or the IgC domain or specific binding fragment of the IgV domain or the IgC domain, or combinations thereof. In some embodiments, the ARBM can be an IgV only, the combination of the IgV and IgC, including the entire extracellular domain (ECD), or any combination of Ig domains. In some embodiments, the ARBM consists or consists essentially of the ECD or an IgD domain or domain thereof of a binding partner of an activating receptor or a ligand of an activating receptor, such as consists or consists essentially of the ECD, IgV or IgC domain or domains.

In some embodiments, the sequence of the ARBM containing an IgD of a binding partner of an activating receptor or a ligand of an activating receptor is a mammalian sequence that includes, but is not limited to, human, mouse, cynomolgus monkey, or rat. In some embodiments, the sequence of ARBM containing an IgD is human. Table 6A and Table 6B provide exemplary residues that correspond to ECD, IgV, or IgC regions of various IgSF domains of binding partners of exemplary activating receptors or ligands of activating receptors.

In some embodiments, the ARBM is or contains a vIgD that contains one or more amino acids modifications, such as one or more substitutions (alternatively, "mutations" or "replacements"), deletions or additions, in an IgD relative to a wild-type or unmodified IgD of a binding partner of the activating receptor or a ligand of the activating receptor. In some aspects, the vIgD contains up to 1, 2, 3, 4, 5, 6, 7, 8, 9, 10, 11, 12, 13, 14, 15, 16, 17, 18, 19 or 20 amino acid modifications, such as amino acid substitutions, deletions or additions in an IgD domain of an IgSF binding partner of an activating receptor, e.g. in an IgD domain of a binding partner set forth in Table 6A, or a ligand of an activating receptor, e.g. in an IgD domain of a binding partner set forth in Table 6B. The modifications (e.g., substitutions) can be in the IgV domain or the IgC domain. In some embodiments, the vIgD has up to 1, 2, 3, 4, 5, 6, 7, 8, 9, 10, 11, 12, 13, 14, 15, 16, 17, 18, 19, or 20 amino acid modifications (e.g., substitutions) in the IgV domain or specific binding fragment thereof. In some embodiments, the vIgD has up to 1, 2, 3, 4, 5, 6, 7, 8, 9, 10, 11, 12, 13, 14, 15, 16, 17, 18, 19, or 20 amino acid modifications (e.g., substitutions) in the IgC domain or specific binding fragment thereof. In some embodiments, the vIgD has at least about 85%, 86%, 86%, 88%, 89%, 90%, 91%, 92%, 93%, 94%, 95%, 96%, 97%, 98%, or 99% sequence identity with the wild-type or unmodified IgD or specific binding fragment thereof.

In some embodiments, the ARBM is a variant of a binding partner of an activating receptor (e.g. variant of a molecule set forth in Table 6A, e.g. human ICOSL, human CD80, human CD86 or human LFA-3 (CD58) or human CD48, in which the ARBM is or comprises an ECD, or portion thereof, containing one or more vIgD of an IgSF binding partner of an activating receptor. In some embodiments, the ARBM is a variant of a binding partner of a ligand of an activating receptor (e.g. variant of a molecule set forth in Table 6B, e.g. human CTLA-4, human CD4, human CD8a, human CD8b or human LAGS, in which the ARBM is or comprises an ECD, or portion thereof, containing one or more vIgD of an IgSF binding partner of a ligand of an activating receptor. In some embodiments, the ARBM can comprise an IgV domain or an IgC domain or domains, or a specific binding fragment of the IgV domain or a specific binding fragment of the IgC domain or domains in which one or more of the IgSF domains (IgV or IgC) contains the one or more amino acid modifications (e.g. substitutions). In some embodiments, the ARBM can comprise an IgV domain and an IgC domain or domains, or a specific binding fragment of the IgV domain and a specific binding fragment of the IgC domain or domains, in which at least one of the IgV or IgC domain contains the amino acid modifications (e.g. substitutions). In some embodiments, the ARBM consists or consists essentially of the ECD containing a vIgD (e.g. IgV and/or IgC). In some embodiments, the ARBM contains only, such as consists or consists essentially of, an IgV domain or a specific binding fragment of the IgV domain, in which the one or more amino acid modifications (e.g. substitutions) are located in the IgV domain or specific binding fragment of the IgV domain. In some embodiments, the ARBM contains only, such as consists or consists essentially of, an IgC domain or a specific binding fragment of the IgC domain, in which the one or more amino acid modifications (e.g. substitutions) are located in an IgC domain or specific binding fragment of an IgC domain.

In some embodiments, the one or more amino acid modifications alter, such as increase, the binding activity, e.g. binding affinity, of the extracellular domain of the binding partner or an IgD domain thereof (e.g. IgV) for its cognate receptor or ligand. In some embodiments, by virtue of the altered binding activity, e.g. binding affinity, the vIgD domain is an affinity-modified IgSF domain. Typically, the affinity-modified IgSF domain used in or as the ARBM is a human or murine affinity modified IgSF domain.

In some embodiments, an ARBM containing a vIgD has a binding activity, such as binding affinity, for an activating receptor or a ligand of an activating receptor that is altered, e.g. increased, from that of an ARBM containing a wild-type or unmodified IgD sequence as determined by, for example, solid-phase ELISA immunoassays, flow cytometry or surface plasmon resonance (Biacore) assays. In some embodiments, the vIgD results in an increased binding activity, such as binding affinity, for the activating receptor or ligand of the activating receptor, relative to a wild-type or unmodified IgD. In some embodiments, the increase in binding activity, such as binding affinity, is at least about 5%, such as at least about 10%, 15%, 20%, 25%, 35%, 40%, 50%, 60%, 70%, 90%, 100%, 200% or more. In some embodiments, the increase in binding activity, such as binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the wild-type or unmodified IgD has the same sequence as the vIgD except that it does not contain the one or more amino acid modifications (e.g. substitutions). In some embodiments, the equilibrium dissociation constant ($K_d$) of the ARBM to the activating receptor or a ligand of the activating receptor can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less.

The use of the term "modification", such as "substitution" does not imply that the present embodiments are limited to a particular method of making the immunomodulatory proteins. An ARBM that is or contains IgD or vIgDs can be made, for example, by de novo peptide synthesis and thus does not necessarily require a modification, such as a "substitution" in the sense of altering a codon to encode for the modification, e.g. substitution. This principle also extends to the terms "addition" and "deletion" of an amino acid residue which likewise do not imply a particular method of making. The means by which the vIgDs are designed or created is not limited to any particular method. In some embodiments, however, a wild-type or unmodified IgD encoding nucleic acid is mutagenized from wild-type or unmodified IgD genetic material and screened for desired specific binding activity, e.g. binding affinity, and/or alteration of IFN-gamma expression or other functional activity. In some embodiments, a vIgD is synthesized de novo utilizing protein or nucleic acid sequences available at any number of publicly available databases and then subsequently screened. The National Center for Biotechnology Information provides such information and its website is publicly accessible via the internet as is the UniProtKB database.

In some embodiments, the ARBM has (i) the sequence of amino acids set forth in SEQ ID NO: 1, 2, 5, 9, 13-15, 3237, or a mature form thereof lacking the signal sequence, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1, 2, 5, 9, 13-15, 3237, or the mature form thereof, or (iii) is a portion of (i) or (ii) containing an IgV domain or IgC domain or specific binding fragments thereof. In some embodiments, the ARBM has (i) the sequence of amino acids (i) set forth in SEQ ID NO: 189, 190, 193, 197, 201, 394, 395 or 3238, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 189, 190, 193, 197, 201, 394, 395 or 3238; or (iii) a portion of (i) or (ii) containing the extracellular domain or an IgV domain or IgC domain or specific binding fragment thereof.

In some embodiments, the ARBM is or comprises an extracellular domain or a portion thereof of an IgSF member that is a binding partner of an activating receptor (e.g. Table 6A). In some cases, the ARBM has or comprises (i) the sequence of amino acids set forth in SEQ ID NO: 28, 29, 32, or 3239, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 28, 29, 32, or 3239 or (iii) is a specific binding fragment of the sequence of (i) or (ii) comprising an IgV domain or an IgC (e.g. IgC2) domain.

In some embodiments, the ARBM is or comprises an IgV domain or an IgC (e.g. IgC2) domain or domains, or a specific binding fragment thereof. In some embodiments, the ARBM has or comprises the amino acid sequence set forth in SEQ ID NO: 1005, 1079, 1195, 2056, 2244, 2615, 2654, 2655, 2946, 2947, or 3580, or an ortholog thereof. For example, the ARBM has or comprises (i) the sequence of amino acids set forth in SEQ ID NO: 1005, 1079, 1195, 2056, 2244, 2615, 2654, 2655, 2946, 2947, or 3580, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 1005, 1079, 1195, 2056, 2244, 2615, 2654, 2655, 2946, 2947, or 3580 or (iii) a specific binding fragment of the sequence of (i) or (ii).

In some embodiments, the ARBM is or comprises an extracellular domain or a portion thereof of an IgSF member that is a binding partner of a ligand of an activating receptor (e.g. Table 6B). In some embodiments, the ARBM has or comprises the amino acid sequence set forth in SEQ ID NO: 36 or 40-42, or an ortholog thereof. In some cases, the ARBM has or comprises (i) the sequence of amino acids set forth in SEQ ID NO: 36 or 40-42 (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 36 or 40-42 or (iii) is a specific binding fragment of the sequence of (i) or (ii) comprising an IgV domain or an IgC (e.g. IgC2) domain.

In some embodiments, the ARBM has or comprises an IgV domain or an IgC domain or domains, or a specific binding fragment thereof. In some embodiments, the ARBM comprises the amino acid sequence set forth in SEQ ID NO: 2947, or an ortholog thereof. For example, the ARBM has or comprises (i) the sequence of amino acids set forth in SEQ ID NO: 2947, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 2947, or (iii) a specific binding fragment of the sequence of (i) or (ii).

1. CD28 Binding Molecules

Provided herein are immunomodulatory proteins containing an ARBM that is or contains a binding molecule that binds to CD28, such as to human CD28. In some embodiments, the ARBM of the immunomodulatory protein binds to the ectodomain of CD28. In some embodiments, the ARBM binds to CD28 on the surface of a cell, such as on the surface of a T cell.

CD28 is a T-cell costimulatory receptors that is engaged by ligands B7-1 (CD80) and B7-2 (CD86) both of which are present on APCs. In some cases, CD28 also can interact with ICOSL at a binding site that overlaps with the binding of ICOSL to the T-cell costimulatory receptor ICOS (Yao et al. (2011) Immunity, 34:729-740). In some cases, an affinity-modified ICOSL containing modifications in an IgSF domain can exhibit increased affinity to CD28 (see e.g., published International PCT App. No. WO 2017/181148). In some cases, the provided immunomodulatory proteins containing an ARBM can bind ICOS (inducible costimulator), which is another T-cell costimulatory receptor engaged by ICOS ligand (ICOSL) on APCs. Although CD28 and ICOS are related CD28 family activating receptors and share some intracellular signaling motifs, costimulatory effects between CD28 and ICOS differ. For example, CD28 is expressed on both unactivated and activated T cells and its signaling is involved in IL-2 production and subsequent T cell effector function. ICOS is generally not expressed on the surface of T cells until after T cell activation, and signaling through ICOS on activated T cells can, in some cases, support specialized T cell subset differentiation. Thus, in some cases, costimulation by CD28 and ICOS yields overlapping and complementary effects.

In some embodiments, the provided immunomodulatory protein contains an ARBM that is or contains an antibody that binds CD28 or is an antigen-binding antibody fragment thereof (e.g. Fab or scFv). In some embodiments, the antibody or antigen-binding antibody fragment binds human CD28. In some embodiments, the antibody is a single chain variable fragment (e.g. scFv) containing a VH and VL of an anti-CD28 antibody or antigen-binding fragment.

In some embodiments, the ARBM is or contains one or more IgD (e.g. IgV or IgC) or a specific binding fragment thereof, such as an unmodified or wild-type IgD or a vIgD or a specific binding fragment thereof, of an IgSF family member that binds CD28. In some embodiments, the CD28 is human CD28. In some embodiment, the ARBM is or contains one or more IgD (e.g. IgV or IgC) that is an IgD of a CD80, CD86 or ICOSL polypeptide, such as a wild-type CD80, CD86 or ICOSL, e.g. a human CD80 or human CD86 or human ICOSL. In some aspects, the ARBM contains one or more IgD (e.g. IgV or IgC) that is an vIgD containing one or more amino acid modifications (e.g., substitutions, deletions or additions) compared to an IgD of a wild-type or unmodified CD80, CD86 or ICOSL, which, in some aspects, result in increased binding of the ARBM to CD28. Exemplary IgDs or vIgDs of CD80, CD86 or ICOSL binding partners for inclusion as an ARBM in the provided immunomodulatory proteins are described. In some embodiments, the ARBM is or contains a vIgD polypeptide that exhibit increased binding activity, such as binding affinity, for CD28 compared to a corresponding wild-type or unmodified IgD.

a. ICOSL IgD or vIgD

Provided herein are immunomodulatory proteins containing an ARBM that is or contains one or more IgD, such as a wild-type or unmodified IgD or a vIgD, of ICOSL. In some embodiments, the ARBM is not the full length sequence of the ICOSL. In some aspects, the ARBM is a soluble polypeptide, is not membrane-expressed and/or lacks the transmembrane and/or cytoplasmic domain of ICOSL. In some embodiments, the ARBM only contains an extracellular domain (ECD) or a specific binding fragment thereof containing a IgD or vIgD, such as only contains an IgV domain or an IgC domain or specific binding fragment thereof, or combinations thereof.

In some embodiments, the ARBM is or contains the ECD sequence set forth in SEQ ID NO:32 or is a specific binding fragment thereof. In some embodiments, the IRBM is or contains an IgV sequence of ICOSL, such as human ICOSL. In some embodiments, the IgV domain contains at least amino acids 1-111, 1-112, 1-113, 1-114, 1-115, 1-116, 1-117, 1-118, 1-119, 1-120, 1-121, 1-122, with reference to numbering set forth in SEQ ID NO:32. In some embodiments, the ARBM is or contain an IgV sequence set forth in SEQ ID NO:2056 or SEQ ID NO: 2244, or is a specific binding fragment thereof.

(SEQ ID NO: 32)

DTQEKEVRAMVGSDVELSCACPEGSRFDLNDVYVYW

QTSESKTVVTYHIPQNSSLENVDSRYRNRALMSPAG

MLRGDFSLRLFNVTPQDEQKFHCLVLSQSLGFQEVL

SVEVTLHVAANFSVPVVSAPHSPSQDELTFTCTSIN

GYPRPNVYWINKTDNSLLDQALQNDTVFLNMRGLYD

VVSVLRIARTPSVNIGCCIENVLLQQNLTVGSQTGN

DIGERDKITENPVSTGEKNAAT (SEQ ID NO: 2056)

DTQEKEVRAMVGSDVELSCACPEGSRFDLNDVYVYW

QTSESKTVVTYHIPQNSSLENVDSRYRNRALMSPAG

MLRGDFSLRLFNVTPQDEQKFHCLVLSQSLGFQEVL

SVE (SEQ ID NO: 2244)

DTQEKEVRAMVGSDVELSCACPEGSRFDLNDVYVYW

QTSESKTVVTYHIPQNSSLENVDSRYRNRALMSPAG

MLRGDFSLRLFNVTPQDEQKFHCLVLSQSLGFQEVL

SVEVTLHVAANFSV

In some embodiments, the immunomodulatory protein contains an ARBM that is or contains a vIgD containing one or more amino acid modifications, e.g. substitutions, in an IgD of a wild-type or unmodified ICOSL. In some embodiments, modifications provided herein can be in an ARBM containing an unmodified IgD set forth in SEQ ID NO:32, 2056 or 2244 or in a sequence that has 85%, 85%, 87%, 88%, 89%, 90%, 91%, 92%, 93%, 94%, 95%, 96%, 97%, 98%, 99% or more sequence identity to SEQ ID NO: 32, 2056 or 2244. In some embodiments, an ARBM containing a vIgD of ICOSL has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 32, 2056 or 2244.

In some embodiments, the ARBM is or contains a vIgD that is an affinity-modified IgSF domain that has an increased binding activity, such as binding affinity, for CD28 relative to the binding activity of the wild-type or unmodified IgD for CD28. In some embodiments, the increase in binding activity, e.g. binding affinity, for CD28 is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions).

In some embodiments, the equilibrium dissociation constant ($K_d$) of the ARBM to CD28 can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less. In some embodiments, the ARBM binds to CD28 with a $K_d$ of from or from about 100 pm to 5000 pm, 100 pm to 2000 pm, 100 pm to 1500 pm, 100 pm to 1000 pm, 100 pm to 800 pm, 100 pm to 500 pm, 100 pm to 400 pm, 400 pm to 4000 pm, 400 pm to 2000 pm, 400 pm to 1500 pm, 400 pm to 1000 pm, 400 pm to 800 pm, 400 pm to 500 pm, 500 pm to 5000 pm, 500 pm to 2000 pm, 500 pm to 1500 pm, 500 pm to 1000 pm, 500 pm to 800 pm, 800 pm to 5000 pm, 800 pm to 2000 pm, 800 pm to 1500 pm, 800 pm to 1000 pm, 1000 pm to 5000 pm, 1000 pm to 2000 pm, 1000 pm to 1500 pm, 1500 pm to 5000 pm, 1500 to 2000 pm to 2000 pm to 50000 pm. In some embodiments, the ABRM binds to CD28 with a $K_d$ of less than 200 pM, 300 pM, 400 pM, 500 pM. In some embodiments, the ABRM binds to CD28 with a $K_d$ of greater than or greater than about 500 pm but less than or less than about 2000 pm, such as from or from about 500 pm to 1500 pm, 500 pm to 1250 pm, 500 pm to 1000 pm, 500 pm to 750 pm, 750 pm to 1500 pm, 750 pm to 1250 pm, 750 pm to 1000 pm, 1000 pm to 2000 pm, 1000 pm to 1500 pm or 1500 pm to 2000 pm.

In some embodiments, the ARBM binds to ICOS. In some embodiments, the variant ARBM binds to ICOS and to CD28. In some aspects, the equilibrium dissociation constant ($K_d$) for binding to ICOS can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M. In some embodiments, the ARBM exhibits a greater binding activity, e.g. binding affinity, for CD28 than for ICOS, such as a binding activity, e.g. binding affinity, that is at least 1.2-fold, 1.5-fold, 2.0-fold, 3.0-fold, 4.0-fold, 5.0-fold or 10.0-fold greater for CD28 than for ICOS. In some embodiments, the ARBM exhibits a greater binding activity, e.g. binding affinity, for ICOS than for CD28, such as a binding activity, e.g. binding affinity, that is at least 1.2-fold, 1.5-fold, 2.0-fold, 3.0-fold, 4.0-fold, 5.0-fold or 10.0-fold greater for ICOS than for CD28.

Unless stated otherwise, the amino acid modification(s) present in a vIgD of a ICOSL ECD or an IgD (e.g. IgV) thereof are designated by amino acid position number corresponding to the numbering of positions of the unmodified ECD sequence set forth in SEQ ID NO:32 or, where applicable, the unmodified IgV sequence set forth in SEQ ID NO: 2056 or 2244. It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs: 32, 2056 or 2244. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the ARBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified ICOSL. In some embodiments, the one or more amino acid modifications, e.g. substitutions, are in the ECD domain of ICOSL or a specific binding fragment thereof. In some embodiments, the one or more amino acid modifications, e.g. substitutions, are in the IgV domain of ICOSL or a specific binding fragment thereof. In some embodiments, the one or more amino acid modifications, e.g. substitutions, are in an IgC domain of ICOSL or a specific binding fragment thereof. In some embodiments, the one or more amino acid modifications, e.g. substitutions, are in the IgV domain of ICOSL or a specific binding fragment thereof and in an IgC domain or domains of ICOSL or a specific binding fragment thereof.

In some embodiments, the ARBM is or contains a vIgD that has one or more amino acid modification, e.g. substitution, in an unmodified IgD of ICOSL or a specific binding fragment there of corresponding to position(s) 10, 11, 13, 16, 18, 20, 25, 27, 30, 33, 37, 42, 43, 47, 52, 54, 57, 61, 62, 67, 71, 72, 74, 77, 78, 75, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 138, 139, 140, 142, 143, 144, 146, 151, 152, 153, 154, 155, 156, 158, 161, 166, 168, 172, 173, 175, 190, 192, 193, 194, 198, 201, 203, 207, 208, 210, 212, 217, 218, 220, 221, 224, 225, or 227 with reference to numbering of SEQ ID NO:32, 2056 or 2244.

In some embodiments, the ARBM is or contains a vIgD of ICOSL that has one or more amino acid modification, e.g. substitution, selected from M10V, M10I, V11E, S13G, E16V, S18R, A20V, S25G, F27S, F27C, N30D, Y33del, Q37R, K42E, T43A, Y47H, N52A, N52C, N52D, N52G, N52H, N52L, N52K, N52M, N52P, N52Q, N52R, N52S, N52T, N52V, N52Y, S54A, S54P, N57A, N57E, N57F, N57H, N57K, N57L, N57M, N57P, N57Q, N57S, N57T, N57V, N57W, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100A, Q100D, Q100E, Q100G, Q100K, Q100L, Q100M, Q100N, Q100R, Q100P, Q100S, Q100T, Q100V, L102R, G103E, V107A, V107I, S109G, S109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140D, C140del, S142F, I143V, I143T, N144D, Y146C, V151A, Y152C, Y152H, W153R, I154F, N155H, N155Q, K156M, D158G, L161P, L161M, L166Q, N168Q, F172S, L173S, M175T, T1905, T190A, S192G, V193M, N194D, C198R, N201S, L203P, L203F, N207Q, L208P, V210A, S212G, D217V, 1218T, 1218N, E220G, R221G, R221I, I224V, T225A, N227K or a conservative amino acid modification, e.g. substitution thereof.

In some embodiments, the ARBM is or contains a vIgD of ICOSL that has two or more amino acid modification, e.g. substitution, selected from M10V, M10I, V11E, S13G, E16V, S18R, A20V, S25G, F27S, F27C, N30D, Y33del, Q37R, K42E, T43A, Y47H, N52A, N52C, N52D, N52G, N52H, N52L, N52K, N52M, N52P, N52Q, N52R, N52S, N52T, N52V, N52Y, S54A, S54P, N57A, N57E, N57F, N57H, N57K, N57L, N57M, N57P, N57Q, N57S, N57T, N57V, N57W, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100A, Q100D, Q100E, Q100G, Q100K, Q100L, Q100M, Q100N, Q100R, Q100P, Q100S, Q100T, Q100V, L102R, G103E, V107A, V107I, S109G, S109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140D, C140del, S142F, I143V, I143T, N144D, Y146C, V151A, Y152C, Y152H, W153R, I154F, N155H, N155Q, K156M, D158G, L161P, L161M, L166Q, N168Q, F172S, L173S, M175T, T190S, T190A, S192G, V193M, N194D, C198R, N201S, L203P, L203F, N207Q, L208P, V210A, S212G, D217V, I218T, I218N, E220G, R221G, R221I, I224V, T225A or N227K.

In some embodiments, the amino acid modification(s), e.g. substitution(s) is N52Y/N57Y/F138L/L203P, N52H/N57Y/Q100P, N52S/Y146C/Y152C, N52H/C198R, N52H/C140D/T225A, N52H/C198R/T225A, N52H/K92R, N52H/S99G, N57Y/Q100P, N52S/G103E, N52S/S130G/Y152C, N52S/Y152C, N52S/C198R, N52Y/N57Y/Y152C, N52Y/N57Y/H129P/C198R, N52H/L161P/C198R, N52S/T113E, N52D/S54P, N52K/L208P, N52S/Y152H, N52D/V151A, N52H/I143T, N52S/L80P, F120S/Y152H/N201S, N52S/R75Q/L203P, N52S/D158G, N52D/Q133H, N52S/N57Y/H94D/L96F/L98F/Q100R, N52S/N57Y/H94D/L96F/L98F/Q100R/G103E/F120S, N52H/F78L/Q100R, N52H/N57Y/Q100R/V110D, N52H/N57Y/R75Q/Q100R/V110D, N52H/N57Y/Q100R, N52H/N57Y/L74Q/Q100R/V110D, N52H/Q100R, N52H/S121G, A20V/N52H/N57Y/Q100R/S109G, N52H/N57Y/Q100P, N52H/N57Y/R61S/Q100R/V110D/L173S, N52H/N57Y/Q100R/V122A, N52H/N57Y/Q100R/F172S, N52H/N57Y, N52S/F120S, N52S/V97A, N52S/G72R, N52S/A71T/A117T, N52S/E220G, Y47H/N52S/V107A/F120S, N52H/N57Y/Q100R/V110D/S132F/M175T, E16V/N52H/N57Y/Q100R/V110D/H115R/Y152C/K156M/C198R, Q37R/N52H/N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N30D/N52S/L67P/Q100K/D217G/R221K/T225S, N52H/N57Y/Q100R/V110D/A117T/T190S/C198R, N52H/N57Y/Q100R/V110D/F172S/C198R, S25G/F27C/N52H/N57Y/Q100R/V110D/E135K/L173S/C198R, N52H/N57Y/V110A/C198R/R221I, M10I/S13G/N52H/N57Y/D77G/V110A/H129P/I143V/F172S/V193M, C198R, N52H/N57Y/R61C/Y62F/Q100R/V110N/F120S/C198R, N52H/N57Y/Q100R/V110D/H115R/C198R, N52H/N57Y/Q100R/V110D/N144D/F172S/C198R, N52S/H94E/L98F/Q100R, N52S/E90A, N30D/K42E/N52S, N52S/F120S/I143V/I224V, N52H/N57Y/Q100R/V110D/C198R/S212G, N52H/N57Y/Q100R/C198R, N52S/N194D, N52H/N57Y/Q100R/L102R/V110D/H115R/C198R, N52S/S54P, T38P/N52S/N57D, N52H/C140del/T225A, N52H/F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/N57Y/Q100R/V110D/S132F/M175T, N52H/N57Y/Q100R/V107I/V110D/I154F/C198R/R221G, Q100R, F138L/L203P, N57Y/F138L/L203P, N57Y/Q100R/C198R, N57Y/F138L/L203P, Q100R/F138L, L203P, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/V122A/F172S/C198R, N52H/N57Y/Q100R/H115R/F172S/N194D, N52H/N57Y/H115R/F172S/C198R, N52H/N57Y/Q100R/H115R/C198R, N52H/N57Y/H115R, N52H/N57Y/Q100R/H115R, N52H/N57Y/Q100R/H115R/F172S/I224V, N52H/N57Y/Q100R/H115R/F172S, N52H/N57Y/Q100R/F172S, N52H/Q100R/H115R/I143T/F172S, N52H/N57Y/Q100P/H115R/F172S, N52Y/N57Y/Q100P/F172S, E16V/N52H/N57Y/Q100R/V110D/H115R/C198R, E16V/N52H/N57Y/Q100R/V110D/H115R/Y152C/K156M/F172S/C198R, N52S/E90A/H115R, N30D/K42E N52S/H115R, N30D/K42E/N52S/H115R/C198R/R221I, N30D/K42E/N52S/H115R/C198R, N30D/K42E/N52S/H115R/F172S/N194D, N52S/H115R/F120S/I143V/C198R, N52S/H115R/F172S/C198R, N52H/N57Y/Q100P/C198R, N52H/N57Y/Q100P H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/F172S/C198R, N52H/Q100R/H115Q/F172S/C198R, N52H/N57Y/Q100R/F172S/C198R, N52Q/N207Q, N168Q/N207Q, N52Q/N168Q, N84Q/N207Q, N155Q/N207Q, N119Q/N168Q, N119Q/N207Q, N119Q/N155Q, N52Q/N84Q, N52Q/N119Q, N84Q/N119Q, N52Q/N84Q/N168Q, N52Q/N84Q/N207Q, N84Q/N155Q/N168Q, N84Q/N168Q/N207Q, N84Q/N155H/N207Q, N155Q/N168Q/N207Q, N119Q/N155Q/N168Q, N119Q/N168Q/N207Q, N84Q/N119Q/N207Q, N119Q/N155H/N207Q, N84Q/N119Q/N155Q, N52Q/N119Q/N155Q, N52H/N84Q/N119Q, N52H/N84Q, N52H/N84Q/N168Q, N52H/N84Q/N207Q, N52H/N84Q/N168Q/N207Q, N52Q/N84Q/N155Q, N52Q/N84Q/N168Q, N52Q/N84Q/N155Q/N168Q, N52Q/N84Q/N119Q/N168Q, N84Q/N119Q/N155Q/N168Q, N84Q/N155Q/N168Q/N207Q, N84Q/N119Q/N155Q/N207Q, N52Q/N84Q/N119Q/N207Q, N52Q/N84Q/N119Q/N155Q, N52Q/N84Q/N119Q/N155Q/N207Q, N84Q/N119Q/N155Q/N168Q/N207Q, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57H/Q100K, N52R/N57L/Q100S, N52R/N57W/Q100K, N52R/N57W, N52R/N57Y/Q100R, N52C/N57E/Q100S, N52G/N57P/Q100D, N52G/N57V/Q100G, N52G/N57V, N52L/N57V, N52P/N57P, N52P/N57S/Q100G, N52S/N57L/Q100G, N52T/N57K/Q100P, N52V/N57T/Q100L, or N57Q/Q100P.

In some embodiments, the ARBM is or an IgD (e.g. IgV) of wild-type ICOSL set forth in Table 7 or a vIgD thereof comprising any of the modifications (e.g. substitutions) listed in Table 7. Table 7 also provides exemplary sequences by reference to SEQ ID NO for ARBMs containing an ECD or IgV domain of ICOSL. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of an ARBM, such as to ensure proper folding of the domain when expressed. Thus, it is understood that the exemplification of the SEQ ID NOS in Table 7 is not to be construed as limiting. For example, the particular domain, such as the ECD or IgV domain, can be several amino acids longer or shorter, such as 1-10, e.g. 1, 2, 3, 4, 5, 6 or 7 amino acids longer or shorter, than the sequence of amino acids set forth in the respective SEQ ID NO. Mutations designated with an "X" indicate the designated position contains a Q or the wild-type residue set forth in the corresponding position of SEQ ID NO: 32.

In some embodiments, the ARBM is or contains a wild-type ICOSL ECD set forth in SEQ ID NO: 32 or a variant ECD sequence set forth in any one of SEQ ID NOS: 2022-2055, 2074, 2076-2121, 2137-2154, 2160-2197, 2200-2206, 2208-2243, 2299-2346. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any one of SEQ ID NOS: 2022-2055, 2074, 2076-2121, 2137-2154, 2160-2197, 2200-2206, 2208-2243, 2299-2346) and contains the amino acid modification(s), e.g. substitution(s) not present in the unmodified or wild-type ICOSL ECD, e.g. not present in SEQ ID NO:32. In some embodiments, the ARBM is or contains a specific binding fragment of any of the ECD sequences set forth in any one of SEQ ID NOS: 2022-2055, 2074, 2076-2121, 2137-2154, 2160-2197, 2200-2206, 2208-2243, 2299-2346) and contains the amino acid modification(s), e.g. substitution (s) not present in the wild-type or unmodified ICOSL ECD, e.g. not present in SEQ ID NO:32.

In some embodiments, the ARBM is or contains a wild-type ICOSL IgV set forth in SEQ ID NO: 2056 or 2244 or a variant IgV sequence set forth in any one of SEQ ID NOS: 2057-2073, 2075, 2122-2136, 2155-2159, 2189-2199, 2207, 2245-2298, 2347-2518. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 2057-2073, 2075, 2122-2136, 2155-2159, 2189-2199, 2207, 2245-2298, 2347-2518 and contains the amino acid modification(s) (e.g. substitution(s)) not present in the unmodified or wild-type ICOSL, e.g. not present in SEQ ID NO:2056 or 2244. In some embodiments, the ARBM is or contains a specific binding fragment of any of the IgV sequences set forth in any one of SEQ ID NOS: 2057-2073, 2075, 2122-2136, 2155-2159, 2189-2199, 2207, 2245-2298, 2347-2518 and that contains the amino acid substitution(s) not present in the unmodified or wild-type ICOSL, e.g. not present in SEQ ID NO:2056 or 2244.

TABLE 7

Exemplary ICOSL ARBMs containing an IgD or vIgD

| Mutation(s) | ECD SEQ ID NO | IgV SEQ ID NO |
|---|---|---|
| Wild-type | 32 | 2056, 2244 |
| N52S | 2022 | 2057, 2245 |
| N52H | 2023 | 2058, 2246 |
| N52D | 2024 | 2059, 2247 |
| N52Y/N57Y/F138L/L203P | 2025 | 2443, 2444 |
| N52H/N57Y/Q100P | 2026 | 261, 2248 |
| N52S/Y146C/Y152C | 2027 | 2057, 2245 |
| N52H/C198R | 2028 | 2058, 2246 |
| N52H/C140D/T225A | 2029 | 2058, 2246 |
| N52H/C198R/T225A | 2030 | 2058, 2246 |
| N52H/K92R | 2031 | 2062, 2249 |
| N52H/S99G | 2032 | 2063, 2250 |
| N52Y | 2033 | 2064, 2251 |
| N57Y | 2034 | 2065, 2252 |
| N57Y/Q100P | 2035 | 2066, 2253 |
| N52S/S130G/Y152C | 2036 | 2057, 2245 |
| N52S/Y152C | 2037 | 2057, 2245 |
| N52S/C198R | 2038 | 2057, 2245 |
| N52Y/N57Y/Y152C | 2039 | 2443, 2444 |
| N52Y/N57Y/H129P/C198R | 2040 | 2443, 2444 |
| N52H/L161P/C198R | 2041 | 2058, 2246 |
| N52S/T113E | 2042 | 2057, 2254 |
| S54A | 2043 | 2067, 2255 |
| N52D/S54P | 2044 | 2068, 2256 |
| N52K/L208P | 2045 | 2446, 2447 |
| N52S/Y152H | 2046 | 2057, 2245 |
| N52D/V151A | 2047 | 2059, 2247 |
| N52H/I143T | 2048 | 2058, 2246 |
| N52S/L80P | 2049 | 2070, 2257 |
| F120S/Y152H/N201S | 2050 | 2056, 2244 |
| N52S/R75Q/L203P | 2051 | 2448, 2449 |
| N52S/D158G | 2052 | 2057, 2245 |
| N52D/Q133H | 2053 | 2059, 2247 |
| N52S/N57Y/H94D/L96F/L98F/Q100R | 2054 | 2072, 2258 |

TABLE 7-continued

Exemplary ICOSL ARBMs containing an IgD or vIgD

| Mutation(s) | ECD SEQ ID NO | IgV SEQ ID NO |
|---|---|---|
| N52S/N57Y/H94D/L96F/L98F/Q100R/G103E/F120S | 2055 | 2450, 2259 |
| N52S/G103E | 2074 | 2075, 2260 |
| N52H/F78L/Q100R | 2076 | 2122, 2261 |
| N52H/N57Y/Q100R/V110D | 2077 | 2123, 2262 |
| N52H/N57Y/R75Q/Q100R/V110D | 2078 | 2124, 2263 |
| N52H/N57Y/Q100R | 2079 | 2125, 2264 |
| N52H/N57Y/L74Q/Q100R/V110D | 2080 | 2126, 2265 |
| N52H/Q100R | 2081 | 2127, 2266 |
| N52H/S121G | 2082 | 2058, 2267 |
| A20V/N52H/N57Y/Q100R/S109G | 2083 | 2128, 2268 |
| N52H/N57Y/Q100P | 2084 | 2129, 2269 |
| N52H/N57Y/R61S/Q100R/V110D/L173S | 2085 | 2452, 2453 |
| N52H/N57Y/Q100R/V122A | 2086 | 2125, 2270 |
| N52H/N57Y/Q100R/F172S | 2087 | 2125, 2264 |
| N52H/N57Y | 2088 | 2130, 2271 |
| N52S/F120S | 2089 | 2057, 2272 |
| N52S/V97A | 2090 | 2131, 2273 |
| N52S/G72R | 2091 | 2132, 2274 |
| N52S/A71T/A117T | 2092 | 2454, 2275 |
| N52S/E220G | 2093 | 2057, 2254 |
| Y47H/N52S/V107A/F120S | 2094 | 2455, 2276 |
| N52H/N57Y/Q100R/V110D/S132F/M175T | 2095 | 2123, 2262 |
| E16V/N52H/N57Y/Q100R/V110D/H115R/Y152C/K156M/C198R | 2096 | 2456, 2457 |
| Q37R/N52H/N57Y/Q100R/V110N/S142F/C198R/D217V/R221G | 2097 | 2458, 2459 |
| N52H/N57Y/Q100R/V110D/C198R | 2098 | 2123, 2262 |
| N52H/N57Y/Q100R/V110D/V116A/L161M/F172S/S192G/C198R | 2099 | 2460, 2461 |
| F27S/N52H/N57Y/V110N | 2100 | 2133, 2277 |
| N52S/H94E/L96I/S109N/L166Q | 2101 | 2462, 2463 |
| S18R/N52S/F93L/I143V/R221G | 2102 | 2464, 2465 |
| A20T/N52D/Y146C/Q164L | 2103 | 2466, 2467 |
| V11E/N30D/N52H/N57Y/H94E/L96I/L98F/N194D/V210A/I218T | 2104 | 2468, 2469 |
| N52S/H94E/L96I/V122M | 2105 | 2470, 2278 |
| N52H/N57Y/H94E/L96I/F1201/S126T/W153R/I218N | 2106 | 2471, 2472 |
| M10V/S18R/N30D/N52S/S126R/T139S/L203F | 2107 | 2473, 2474 |
| S25G/N30D/N52S/F120S/N227K | 2108 | 2475, 2476 |
| N30D/N52S/L67P/Q100K/D217G/R221K/T225S | 2109 | 2477, 2478 |
| N52H/N57Y/Q100R/V110D/A117T/T190S/C198R | 2110 | 2123, 2479 |
| N52H/N57Y/Q100R/V110D/F172S/C198R | 2111 | 2123, 2262 |
| S25G/F27C/N52H/N57Y/Q100R/V110D/E135K/L173S/C198R | 2112 | 2480, 2481 |
| N52H/N57Y/V110A/C198R/R2211 | 2113 | 2482, 2483 |
| M10I/S13G/N52H/N57Y/D77G/V110A/H129P/I143V/F172S/V193M/C198R | 2114 | 2484, 2485 |
| N52H/N57Y/R61C/Y62F/Q100R/V110N/F120S/C198R | 2115 | 2486, 2487 |
| N52H/N57Y/Q100R/V110D/H115R/C198R | 2116 | 2123, 2488 |
| N52H/N57Y/Q100R/V110D/N144D/F172S/C198R | 2117 | 2123, 2262 |
| N52S/H94E/L98F/Q100R | 2118 | 2134, 2279 |
| N52S/E90A | 2119 | 2135, 2280 |
| N30D/K42E/N52S | 2120 | 2136, 2281 |
| N52S/F120S/I143V/I224V | 2121 | 2057, 2272 |
| N52H/N57Y/Q100R/V110D/C198R/S212G | 2137 | 2489, 2490 |
| N52H/N57Y/Q100R/C198R | 2138 | 2125, 2264 |
| N52S/N194D | 2139 | 2057, 2245 |
| N52H/N57Y/Q100R/L102R/V110D/H115R/C198R | 2140 | 291, 2492 |
| N52S/S54P | 2141 | 2155, 2282 |
| T38P/N52S/N57D | 2142 | 2156, 2283 |
| E111del | 2143 | 2157, 2284 |
| Y33del | 2144 | 2158, 2285 |
| N52H/C140del/T225A | 2145 | 2058, 2246 |
| N52H/F78L/Q100R/C198R | 2146 | 2122, 2261 |
| N52H/N57Y/R75Q/Q100P/V110D | 2147 | 2159, 2286 |
| N52H/N57Y/L74Q/V110D/S192G | 2148 | 2493, 2494 |
| N52H/S121G/C198R | 2149 | 2058, 2267 |
| N52S/F120S/N227K | 2150 | 2057, 2272 |
| N52S/A71T/A117T/T190A/C198R | 2151 | 2454, 2275 |
| T43A/N52H/N57Y/L74Q/D89G/V110D/F172S | 2152 | 2451, 2495 |
| N52H/N57Y/Q100R/V110D/S132F/M175T | 2153 | 2123, 2262 |
| N52H/N57Y/Q100R/V1071/V110D/I154F/C198R/R221G | 2154 | 2496, 2497 |
| N84Q | 2160 | 2198, 2287 |
| N119Q | 2161 | 2056, 2503 |
| N168Q | 2162 | 2056, 2244 |
| N207Q | 2163 | 2056, 2244 |
| N52Q/N207X | 2164 | 2498, 2499 |
| N168X/N207X | 2165 | 2056, 2244 |
| N52Q/N168Q | 2166 | 2498, 2499 |
| N84Q/N207Q | 2167 | 2198, 2501 |
| N155Q/N207Q | 2168 | 2056, 2244 |

TABLE 7-continued

| Exemplary ICOSL ARBMs containing an IgD or vIgD | | |
|---|---|---|
| Mutation(s) | ECD SEQ ID NO | IgV SEQ ID NO |
| N119Q/N168Q | 2169 | 2056, 2503 |
| N119Q/N207Q | 2170 | 2056, 2503 |
| N119Q/N155X | 2171 | 2056, 2503 |
| N52Q/N84Q | 2172 | 2199, 2289 |
| N52Q/N119Q | 2173 | 2498, 2290 |
| N84Q/N119Q | 2174 | 2198, 2291 |
| N52Q/N84Q/N168Q | 2175 | 2199, 2289 |
| N52Q/N84Q/N207Q | 2176 | 2199, 2289 |
| N84Q/N155Q/N168Q | 2177 | 2198, 2287 |
| N84Q/N168Q/N207Q | 2178 | 2198, 2287 |
| N84Q/N155H/N207Q | 2179 | 2198, 2287 |
| N155Q/N168Q/N207Q | 2180 | 2056, 2244 |
| N119QN155Q/N168Q | 2181 | 2056, 2503 |
| N119Q/N168Q/N207Q | 2182 | 2056, 2503 |
| N84Q/N119Q/N207Q | 2183 | 2198, 2291 |
| N119Q/N155H/N207Q | 2184 | 2056, 2503 |
| N84Q/N119Q/N155Q | 2185 | 2198, 2291 |
| N52Q/N119Q/N155Q | 2186 | 2498, 2290 |
| N52H/N84Q/N119Q | 2187 | 2500, 2292 |
| N52H/N84Q/N168X/N207X | 2188 | 2500, 2502 |
| N52Q/N84Q/N155X/N168X | 2189 | 2199, 2289 |
| N52Q/N84Q/N119Q/N168Q | 2190 | 2199, 2504 |
| N84Q/N119Q/N155Q/N168Q | 2191 | 2198, 2291 |
| N84Q/N155Q/N168Q/N207Q | 2192 | 2198, 2287 |
| N84Q/N119Q/N155Q/N207Q | 2193 | 2198, 2291 |
| N52Q/N84Q/N119Q/N207Q | 2194 | 2199, 2504 |
| N52Q/N84Q/N119Q/N155Q | 2195 | 2199, 2504 |
| N52Q/N84Q/N119Q/N155Q/N207Q | 2196 | 2199, 2504 |
| N84Q/N119Q/N155Q/N168Q/N207Q | 2197 | 2198, 2291 |
| Q100R | 2200 | 2207, 2293 |
| F138L/L203P | 2201 | 2056, 2244 |
| N52Y/F138L/L203P | 2202 | 2064, 2251 |
| N57Y/Q100R/C198R | 2203 | 2505, 2506 |
| N57Y/F138L/L203P | 2204 | 2065, 2252 |
| Q100R/F138L | 2205 | 2507, 2508 |
| L203P | 2206 | 2056, 2244 |
| N52H/N57Y/Q100R/H115R/C198R | 2208 | 2125, 2295 |
| N52H/N57Y/Q100R/F172S/C198R | 2209 | 2125, 2264 |
| N52H/N57Y/Q100R/H115R/F172S/C198R | 2210 | 2125, 2295 |
| N52H/N57Y/Q100R/H115R/I143V/F172S/C198R | 2211 | 2125, 2295 |
| N52H/N57Y/Q100R/L102R/H115R/F172S/C198R | 2212 | 2510, 2511 |
| N52H/V122A/F172S/C198R | 2213 | 2058, 2512 |
| N52H/N57Y/Q100R/H115R/F172S/N194D | 2214 | 2125, 2295 |
| N52H/N57Y/H115R/F172S/C198R | 2215 | 2130, 2294 |
| N52H/N57Y/Q100R/H115R/C198R | 2216 | 2125, 2295 |
| N52H/N57Y/H115R | 2217 | 2130, 2294 |
| N52H/N57Y/Q100R/H115R | 2218 | 2125, 2295 |
| N52H/N57Y/Q100R/H115R/F172S/I224V | 2219 | 2125, 2295 |
| N52H/N57Y/Q100R/H115R/F172S | 2220 | 2125, 2295 |
| N52H/N57Y/Q100R/F172S | 2221 | 2125, 2264 |
| N52H/Q100R/H115R/I143T/F172S | 2222 | 2127, 2513 |
| N52H/N57Y/Q100P/H115R/F172S | 2223 | 2129, 2514 |
| N52Y/N57Y/Q100P/F172S | 2224 | 2515, 2516 |
| E16V/N52H/N57Y/Q100R/V110D/H115R/C198R | 2225 | 2456, 2457 |
| E16V/N52H/N57Y/Q100R/V110D/H115R/Y152C/K156M/F172S/C198R | 2226 | 245, 2457 |
| N52S/E90A/H115R | 2227 | 235, 2296 |
| N30D/K42E/N52S/H115R | 2228 | 2517, 2297 |
| N30D/K42E/N52S/H115R/C198R/R221I | 2229 | 2517, 2297 |
| N30D/K42E/N52S/H115R/C198R | 2230 | 2517, 2297 |
| N30D/K42E/N52S/H115R/F172S/N194D | 2231 | 2517, 2297 |
| N52S/H115R/F120S/I143V/C198R | 2232 | 2057, 2518 |
| N52S/H115R/F172S/C198R | 2233 | 2057, 2514 |
| N52H/N57Y/Q100P/C198R | 2234 | 2129, 2269 |
| N52H/N57Y/Q100P/H115R/F172S/C198R | 2235 | 2129, 2298 |
| N52H/N57Y/Q100P/F172S/C198R | 2236 | 2129, 2269 |
| N52H/N57Y/Q100P/H115R | 2237 | 2129, 2298 |
| N52H/N57Y/Q100P/H115R/C198R | 2238 | 2129, 2298 |
| N52H/Q100R/C198R | 2239 | 2127, 2266 |
| N52H/Q100R/H115R/F172S | 2240 | 2127, 2513 |
| N52H/Q100R/H115X/F172S/C198R | 2241 | 2127, 2509 |
| N52H/Q100R/H115R/F172S/C198R | 2242 | 2127, 2513 |
| N52H/N57Y/Q100R/F172S/C198R | 2243 | 2125, 2264 |
| N52A/N57F/Q100S | 2299 | 2347, 2395 |
| N52A/N57H/Q100S | 2300 | 2348, 2396 |
| N52A/N57Y/Q100A | 2301 | 2349, 2397 |

TABLE 7-continued

| Exemplary ICOSL ARBMs containing an IgD or vIgD | | |
|---|---|---|
| Mutation(s) | ECD SEQ ID NO | IgV SEQ ID NO |
| N52D/N57A/Q100A | 2302 | 2350, 2398 |
| N52D/Q100S | 2303 | 2351, 2399 |
| N52G/Q100A | 2304 | 2352, 2400 |
| N52H/Q100A | 2305 | 2353, 2401 |
| N52M/N57H/Q100S | 2306 | 2354, 2402 |
| N52M/N57W/Q100P | 2307 | 2355, 2403 |
| N52Q/N57F | 2308 | 2356, 2404 |
| N52Q/N57S/Q100A | 2309 | 2357, 2405 |
| N52R/N57L/Q100A | 2310 | 2358, 2406 |
| N52R/N57Y/Q100P | 2311 | 2359, 2407 |
| N52R/N57Y/Q100S | 2312 | 2360, 2408 |
| N52S/N57A/Q100A | 2313 | 2361, 2409 |
| N52S/N57H/Q100E | 2314 | 2362, 2410 |
| N52S/N57L/Q100S | 2315 | 2363, 2411 |
| N52S/N57M/Q100S | 2316 | 2364, 2412 |
| N52S/N57Y/Q100S | 2317 | 2365, 2413 |
| N52S/N57Y/Q100M | 2318 | 2366, 2414 |
| N52S/N57Y/Q100V | 2319 | 2367, 2415 |
| N52T/N57H/Q100S | 2320 | 2368, 2416 |
| N52T/N57H/Q100A | 2321 | 2369, 2417 |
| N52T/N57Y/Q100A | 2322 | 2370, 2418 |
| N52V/N57L/Q100A | 2323 | 2371, 2419 |
| N52H/N57Y/Q100K | 2324 | 2372, 2420 |
| N52K/N57Y/Q100R | 2325 | 2373, 2421 |
| N52L/N57H/Q100R | 2326 | 2374, 2422 |
| N52R/N57F/Q100N | 2327 | 2375, 2423 |
| N52R/N57F/Q100P | 2328 | 2376, 2424 |
| N52R/N57F/Q100R | 2329 | 2377, 2425 |
| N52R/N57F/Q100T | 2330 | 2378, 2426 |
| N52R/N57H/Q100K | 2331 | 2379, 2427 |
| N52R/N57L/Q100S | 2332 | 2380, 2428 |
| N52R/N57W/Q100K | 2333 | 2381, 2429 |
| N52R/N57W | 2334 | 2382, 2430 |
| N52R/N57Y/Q100R | 2335 | 2383, 2431 |
| N52C/N57E/Q100S | 2336 | 284, 2432 |
| N52G/N57P/Q100D | 2337 | 2385, 2433 |
| N52G/N57V/Q100G | 2338 | 2386, 2434 |
| N52G/N57V | 2339 | 2387, 2435 |
| N52L/N57V | 2340 | 2388, 2436 |
| N52P/N57P | 2341 | 2389, 2437 |
| N52P/N57S/Q100G | 2342 | 2390, 2438 |
| N52S/N57L/Q100G | 2343 | 2391, 2439 |
| N52T/N57K/Q100P | 2344 | 2392, 2440 |
| N52V/N57T/Q100L | 2345 | 2393, 2441 |
| N57Q/Q100P | 2346 | 2394, 2442 |

In some embodiments, the ARBM is or contains a vIgD that contains one or more amino acid modifications (e.g. substitutions) corresponding to a position(s) selected from 52, 57, 100, 110, or 198. In some embodiments, the one or more amino acid modifications are selected from N52H, N52D, N52S, N52K, S54A, S54P, N57Y, Q100P, Q100R, V110A, V110D, C198R, or a conservative amino acid substitution thereof.

In some embodiments, the variant ICOSL polypeptide has one or more amino acid substitutions including N52S, N52S, N52D, N52Y/N57Y/F138L/L203P, N52H/N57Y/Q100P, N52S/Y146C/Y152C, N52H/C198R, N52H/C140del/T225A, N52H/C198R/T225A, N52H/K92R, N52H/S99G, N57Y, N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, S54A, N52D/S54P, N52K/L208P, N52S/Y152H, N52H/I143T, N52S/L80P, N52S/D158G, N52D/Q133H, N52H/N57Y/Q100R/V110D/C198R/S212G, N52H/N57Y/Q100R/C198R, N52H/N57Y/L74Q/V110D/S192G, N52H/Q100R, N52H/S121G/C198R, A20V/N52H/N57Y/Q100R/S109G, N52H/N57Y/Q100P/C198R, N52H/N57Y/Q100R/V122A, N52H/N57Y/Q100R/F172S, N52H/N57Y/Q100R, N52S/F120S/N227K, N52S/N194D, N52S/F120S, N52S/G72R, N52S/A71T/A117T/T190A/C198R, N52H/N57Y/Q100R/V107I/V110D/S132F/I154F/C198R/R221G, E16V/N52H/N57Y/Q100R/V110D/H115R/Y152C/K156M/C198R, N52H/N57Y/Q100R/V110D/C198R, F27S/N52H/N57Y/V110N, N52S/H94E/L96I/S109N/L166Q, S18R/N52S/F93L/I143V/R221G, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N52H/N57Y/Q100R/V110D/F172S/C198R, S25G/F27C/N52H/N57Y/Q100R/V110D/E135K/L173S/C198R, N52H/N57Y/V110A/C198R/R221I, N52H/N57Y/Q100R/L102R/V110D/H115R/C198R, N52H/N57Y/Q100R/V110D/N144D/F172S/C198R, N52S/H94E/L98F/Q100R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/

C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/H115X/F172S/C198R, N52H/Q100R/H115R/F172S/C198R, N52H/N57Y/Q100R/F172S/C198R, N52H/N57Y/Q100R/H115R/F172S/C198R, N52H/N57Y/Q100R/H115R/F172S, Q100R, N52Y/F138L/L203P, N57Y/Q100R/C198R, N57Y/F138L/L203, N52H, N57Y, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/N57Y/Q100R/H115R/F172S/N194D, N52H/N57Y/H115R/F172S/C198R, N52H/N57Y/Q100R/H115R/C198R, N52H/N57Y/H115R, N52H/Q100R/H115R/I143T/F172S, N52H/N57Y/Q100P/H115R/F172S, E16V/N52H/N57Y/Q100R/V110D/H115R/C198R, N30D/K42E/N52S/H115R/C198R/R221I, N52S/E90A/H115R, N30D/K42E/N52S/H115R, N52S/H115R/F172S/C198R, N119Q, N207Q, N52Q/N207X, N168X/N207X, N52Q/N168Q, N84Q/N207Q, N119Q/N168Q, N119Q/N207Q, N119Q/N155X, N52Q/N119Q, N52Q/N84Q/N207Q, N119Q/N155Q/N168Q, N52Q/N84Q/N155X/N168X, N52Q/N84Q/N119Q/N168Q, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57L/Q100S, N52R/N57W/Q100K, N52R/N57W, N52G/N57V, N52L/N57V, N52S/N57L/Q100G, N52T/N57K/Q100P.

b. CD80 IgD or vIgD

Provided herein are immunomodulatory proteins containing an ARBM that is or contains one or more IgD, such as a wild-type or unmodified IgD or a vIgD, of CD80. In some embodiments, the ARBM is not the full length sequence of the CD80. In some aspects, the ARBM is a soluble polypeptide, is not membrane-expressed and/or lacks the transmembrane and/or cytoplasmic domain of CD80. In some embodiments, the ARBM only contains an extracellular domain (ECD) or a specific binding fragment thereof containing a IgD or vIgD, such as only contains an IgV domain or an IgC domain or specific binding fragment thereof, or combinations thereof.

In some embodiments, the ARBM is or contains the ECD sequence set forth in SEQ ID NO:28 or a specific binding fragment thereof. In some embodiments, the ARBM is or contains an IgV sequence set forth in SEQ ID NOs: 1005, 1079, 2615, 2654, or 3580, or is a specific binding fragment thereof.

```
                                  (SEQ ID NO: 28)
VIHVTKEVKEVATLSCGHNVSVEELAQTRIYWQKEK

KMVLTMMSGDMNIWPEYKNRTIFDITNNLSIVILAL

RPSDEGTYECVVLKYEKDAFKREHLAEVTLSVKADF
```

-continued

```
PTPSISDFEIPTSNIRRIICSTSGGFPEPHLSWLEN

GEELNAINTTVSQDPETELYAVSSKLDFNMTTNHSF

MCLIKYGHLRVNQTFNWNTTKQEHFPDN

                                (SEQ ID NO: 1005)
VIHVTKEVKEVATLSCGHNVSVEELAQTRIYWQKEK

KMVLTMMSGDMNIWPEYKNRTIFDITNNLSIVILAL

RPSDEGTYECVVLKYEKDAFKREHLAEVT

                                (SEQ ID NO: 1079)
VIHVTKEVKEVATLSCGHNVSVEELAQTRIYWQKEK

KMVLTMMSGDMNIWPEYKNRTIFDITNNLSIVIQAL

RPSDEGTYECVVLKYEKDGFKREHLAEVTLSVKAD

                                (SEQ ID NO: 2615)
VIHVTKEVKEVATLSCGHNVSVEELAQTRIYWQKEK

KMVLTMMSGDMNIWPEYKNRTIFDITNNLSIVIQAL

RPSDEGTYECVVLKYEKDGFKREHLAEVTLSVKADF

                                (SEQ ID NO: 2654)
VIHVTKEVKEVATLSCGHNVSVEELAQTRIYWQKEK

KMVLTMMSGDMNIWPEYKNRTIFDITNNLSIVILAL

RPSDEGTYECVVLKYEKDAFKREHLAEV

                                (SEQ ID NO: 3580)
VIHVTKEVKEVATLSCGHNVSVEELAQTRIYWQKEK

KMVLTMMSGDMNIWPEYKNRTIFDITNNLSIVILAL

RPSDEGTYECVVLKYEKDAFKREHLAEVTLSVKAD
```

In some embodiments, the immunomodulatory protein contains an ARBM that is or contains a vIgD containing one or more amino acid modifications, e.g. substitutions, in an IgD of a wild-type or unmodified CD80. In some embodiments, modifications provided herein can be in an ARBM containing an unmodified IgD set forth in SEQ ID NO: 28, 1005, 1079, 2615, 2654, or 3580 or in a sequence that has 85%, 85%, 87%, 88%, 89%, 90%, 91%, 92%, 93%, 94%, 95%, 96%, 97%, 98%, 99% or more sequence identity to SEQ ID NO: 28, 1005, 1079, 2615, 2654, or 3580. In some embodiments, an ARBM containing a vIgD of CD80 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 28, 1005, 1079, 2615, 2654, or 3580.

In some embodiments, the ARBM is or contains a vIgD that is an affinity-modified IgSF domain that has an increased binding activity, such as binding affinity, for CD28 relative to the binding activity of the wild-type or unmodified IgD for CD28. In some embodiments, the increase in binding activity, e.g. binding affinity, for CD28 is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions).

In some embodiments, the equilibrium dissociation constant ($K_d$) of the ARBM to CD28 can be less than $1\times10^{-5}$M, $1 \times 10^{-6}$ M, $1 \times 10^{-7}$ M, $1 \times 10^{-8}$ M, $1 \times 10^{-9}$ M, $1 \times 10^{-10}$ M or $1 \times 10^{-11}$M, or $1 \times 10^{-12}$ M or less. In some embodiments, the ARBM binds to CD28 with a $K_d$ of from or from about 100 pm to 5000 pm, 100 pm to 2000 pm, 100 pm to 1500 pm, 100 pm to 1000 pm, 100 pm to 800 pm, 100 pm to 500 pm, 100 pm to 400 pm, 400 pm to 4000 pm, 400 pm to 2000 pm, 400 pm to 1500 pm, 400 pm to 1000 pm, 400 pm to 800 pm, 400 pm to 500 pm, 500 pm to 5000 pm, 500 pm to 2000 pm, 500 pm to 1500 pm, 500 pm to 1000 pm, 500 pm to 800 pm, 800 pm to 5000 pm, 800 pm to 2000 pm, 800 pm to 1500 pm, 800 pm to 1000 pm, 1000 pm to 5000 pm, 1000 pm to 2000 pm, 1000 pm to 1500 pm, 1500 pm to 5000 pm, 1500 to 2000 pm to 2000 pm to 50000 pm. In some embodiments, the ABRM binds to CD28 with a $K_d$ of less than 200 pM, 300 pM, 400 pM, 500 pM. In some embodiments, the ABRM binds to CD28 with a $K_d$ of greater than or greater than about 500 pm but less than or less than about 2000 pm, such as from or from about 500 pm to 1500 pm, 500 pm to 1250 pm, 500 pm to 1000 pm, 500 pm to 750 pm, 750 pm to 1500 pm, 750 pm to 1250 pm, 750 pm to 1000 pm, 1000 pm to 2000 pm, 1000 pm to 1500 pm or 1500 pm to 2000 pm.

In some aspects, a vIgD of CD80 may exhibit increased binding activity, e.g. binding affinity, to the inhibitory receptor CTLA-4. In some embodiments, the increase in binding activity, e.g. binding affinity, for CTLA-4 is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, such a vIgD may be used as an IRBM in the embodiments provided herein. In some embodiments, the equilibrium dissociation constant ($K_d$) of the IRBM to CTLA-4 can be less than $1 \times 10^{-5}$M, $1 \times 10^{-6}$ M, $1 \times 10^{-7}$ M, $1 \times 10^{-8}$ M, $1 \times 10^{-9}$ M, $1 \times 10^{-10}$ M or $1 \times 10^{-11}$M, or $1 \times 10^{-12}$ M or less. In some embodiments, such an IRBM exhibits a greater binding activity, e.g. binding affinity, for CTLA-4 than for CD28, such as a binding activity, e.g. binding affinity, that is at least 1.2-fold, 1.5-fold, 2.0-fold, 3.0-fold, 4.0-fold, 5.0-fold or 10.0-fold greater for CTLA-4 than for CD28.

Unless stated otherwise, the amino acid modification(s) present in a vIgD of a CD80 ECD or an IgD (e.g. IgV) thereof are designated by amino acid position number corresponding to the numbering of positions of the unmodified ECD sequence set forth in SEQ ID NO:28 or, where applicable, the unmodified IgV sequence set forth in SEQ ID NO: 1005, 1079, 2615, 2654, or 3580. It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs: 28, 1005, 1079, 2615, 2654, or 3580. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the ARBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified CD80. In some embodiments, the one or more amino acid modifications, e.g. substitutions, are in the ECD domain of CD80 or a specific binding fragment thereof. In some embodiments, the one or more amino acid modifications, e.g. substitutions, are in the IgV domain of CD80 or a specific binding fragment thereof. In some embodiments, the one or more amino acid modifications, e.g. substitutions, are in an IgC domain of CD80 or a specific binding fragment thereof. In some embodiments, the one or more amino acid modifications, e.g. substitutions, are in the IgV domain of CD80 or a specific binding fragment thereof and in an IgC domain or domains of CD80 or a specific binding fragment thereof.

In some embodiments, the ARBM is or contains a vIgD that has one or more amino acid modifications (e.g., substitutions) in an unmodified IgD of CD80 or specific binding fragment thereof corresponding to position(s) 4, 7, 9, 10, 11, 12, 13, 14, 15, 16, 17, 18, 20, 21, 22, 23, 24, 25, 26, 27, 28, 29, 30, 31, 33, 34, 35, 36, 37, 38, 40, 41, 42, 43, 44, 46, 47, 48, 50, 51, 52, 53, 54, 55, 57, 58, 59, 60, 61, 62, 63, 64, 65, 66, 67, 68, 69, 70, 71, 72, 73, 74, 76, 77, 78, 79, 80, 81, 82, 83, 84, 85, 86, 87, 88, 89, 90, 91, 92, 93, 94, 95, 96, 97, 99, 102, 103, 104, 107, 108, 109, 110, 114, 115, 116, 117, 118, 120, 121, 122, 126, 127, 128, 129, 130, 133, 137, 140, 142, 143, 144, 148, 149, 152, 154, 160, 162, 164, 168, 169, 174, 175, 177, 178, 183, 185, 188, 190, 192, 193 or 199 with reference to numbering of SEQ ID NO: 28, 1005, 1079, 2615, 2654, or 3580.

In some embodiments, the ARBM is or contains a vIgD of CD80 that has one or more amino acid modifications, e.g. substitutions, selected from among V4M, E7D, K9E, E10R, V11S, A12G, A12T, A12V, T13N, T13A, T13R, L14A, S15V, S15F, 515P, C165, C16G, C16L, C16R, G17W, H18L, H18R, H18Y, V20A, V20I, V20L, S21P, V22A, V22I, V22D, V22L, E23D, E23G, E24D, E24G, L25P, L25S, A26E, A26P, A26S, A26T, Q27H, Q27L, Q27R, T28A, T28S, R29C, R29D, R29H, R29V, I30F, I30T, I30V, Y31F, Y31H, Y31L, Y31S, Q33E, Q33H, Q33K, Q33L, Q33R, K34E, E35D, E35G, K36E, K36G, K36R, K37E, K37Q, M38I, M38L, M38T, M38V, L40M, T41A, T41G, T41D, T41I, T41S, M42I, M42T, M42V, M431, M43L, M43Q, M43R, M43T, M43V, S44P, D46E, D46V, M471, M47L, M47T, M47V, N48H, N48D, N48H, N48I, N48K, N48R, N48S, N48T, W50G, P51A, E52G, Y53C, Y53F, K54M, K54E, K54N, K54R, N55D, N55I, T57A, T57I, I58V, F59L, F59S, D60V, I61N, I61V, T62A, T62N, T62S, N63S, N64S, L65H, L65P, S66H, I67F, I67L, I67T, I67V, V68A, V68E, V68L, V68M, I69F, I69T, L70M, L70P, L70R, L70Q, A71D, A71G, L72V, L72P, R73H, R73S, P74L, P74S, D76G, D76H, E77A, E77G, E77K, G78A, T79A, T791, T79L, T79P, Y80N, E81A, E81G, E81K, E81R, E81V, C82R, V83A, V83I, V84A, V84I, L85E, L85I, L85M, L85R, L85Q, K86E, K86M, Y87H, Y87N, E88D, E88G, E88V, K89E, K89N, K89R, D90K, D90L, D90N, A91E, A91G, A91S, A91T, F92L, F92N, F92P, F92S, F92V, F92Y, K93I, K93E, K93Q, K93R, K93V, R94G, R94L, R94F, R94Q, R94W, E95D, E95K, E95V, H96R, L97M, L97R, L97Q, E99D, E99G, L1025, 5103L, S103P, V104A, V104L, D107N, F108L, P1095, P109H, T110A, D115G, S114T, F1165, F116L, E117V, E117G, I118V, I118A, I118T, T120S, S121P, N122S, I126L, I126V, I127T, C128Y, C128R, 5129L, S129P, T130A, G133D, P137L, 5140T, L1425, E143G, N144D, N144S, L1485, N149D, N149S, N152T, T1541, T154A, E160G, E162G, Y164H, S168G, K169E, K1691, K1695, M174T, M174V, T175A, N177S, H178R, L183H, K185E, H188D, H188Q, R1905, N192D, Q193L, or T1995 or a conservative amino acid modification, e.g. substitution thereof.

In some embodiments, the ARBM is or contains a vIgD of CD80 that has two or more amino acid modifications, e.g. substitutions, selected from among V4M, E7D, K9E, E10R, V11S, A12G, A12T, A12V, T13N, T13A, T13R, L14A, S15V, S15F, S15P, C16S, C16G, C16L, C16R, G17W, H18L, H18R, H18Y, V20A, V20I, V20L, S21P, V22A, V22I, V22D, V22L, E23D, E23G, E24D, E24G, L25P, L25S, A26E, A26P, A26S, A26T, Q27H, Q27L, Q27R, T28A, T28S, R29C, R29D, R29H, R29V, I30F, I30T, I30V, Y31F, Y31H, Y31L, Y31S, Q33E, Q33H, Q33K, Q33L, Q33R, K34E, E35D, E35G, K36E, K36G, K36R, K37E, K37Q, M38I, M38L, M38T, M38V, L40M, T41A, T41G, T41D, T41I, T41S, M42I, M42T, M42V, M43I, M43L, M43Q, M43R, M43T, M43V, S44P, D46E, D46V, M47I, M47L, M47T, M47V, N48H, N48D, N48H, N48I, N48K, N48R, N48S, N48T, W50G, P51A, E52G, Y53C, Y53F, K54M, K54E, K54N, K54R, N55D, N55I, T57A, T57I, I58V, F59L, F59S, D60V, I61N, I61V, T62A, T62N, T62S, N63S, N64S, L65H, L65P, S66H, I67F, I67L, I67T, I67V, V68A, V68E, V68L, V68M, I69F, I69T, L70M, L70P, L70R, L70Q, A71D, A71G, L72V, L72P, R73H, R73S, P74L, P74S, D76G, D76H, E77A, E77G, E77K, G78A, T79A, T79I, T79L, T79P, Y80N, E81A, E81G, E81K, E81R, E81V, C82R, V83A, V83I, V84A, V84I, L85E, L85I, L85M, L85R, L85Q, K86E, K86M, Y87H, Y87N, E88D, E88G, E88V, K89E, K89N, K89R, D90K, D90L, D90N, A91E, A91G, A91S, A91T, F92L, F92N, F92P, F92S, F92V, F92Y, K93I, K93E, K93Q, K93R, K93V, R94G, R94L, R94F, R94Q, R94W, E95D, E95K, E95V, H96R, L97M, L97R, L97Q, E99D, E99G, L102S, S103L, S103P, V104A, V104L, D107N, F108L, P109S, P109H, T110A, D115G, S114T, F116S, F116L, E117V, E117G, I118V, I118A, I118T, T120S, S121P, N122S, I126L, I126V, I127T, C128Y, C128R, S129L, S129P, T130A, G133D, P137L, S140T, L142S, E143G, N144D, N144S, L148S, N149D, N149S, N152T, T1541, T154A, E160G, E162G, Y164H, S168G, K169E, K1691, K169S, M174T, M174V, T175A, N177S, H178R, L183H, K185E, H188D, H188Q, R190S, N192D, Q193L, or T199S.

In some embodiments, the one or more amino acid modification(s), e.g. substitution(s) is 130F/L70P, Q27H/T41S/A71D, I30T/L70R, T13R/C16R/L70Q/A71D, T57I, M43I/C82R, V22L/M38V/M47T/A71D/L85M, I30V/T57I/L70P/A71D/A91T, V22I/L70M/A71D, N55D/L70P/E77G, T57A/I69T, N55D/K86M, L72P/T791, T79P, E35D/M47I/L65P/D90N, L25S/E35D/M47I/D90N, A71D, T13A/I61N/A71D, K34E/T41A/L72V, T41S/A71D/V84A, E35D/A71D, E35D/M47I, K36R/G78A, S44P/A71D, Q27H/M43I/A71D/R73S, Q33R/K54N/T57I/I67V/A71D, E35D/T57I/L70Q/A71D, M42I/I61V/A71D, P51A/A71D, H18Y/M47I/T57I/A71G, V20I/M47V/T57I/V841, V20I/M47V/A71D, A71D/L72V/E95K, V22L/E35G/A71D/L72P, E35D/A71D, E35D/I67L/A71D, Q27H/E35G/A71D/L72P/T79I, T13R/M42V/M47I/A71D, E35D, E35D/M47I/L70M, E35D/A71D/L72V, E35D/M43L/L70M, A26P/E35D/M43I/L85Q/E88D, E35D/D46V/L85Q, Q27L/E35D/M47I/T57I/L70Q/E88D, M47V/I69F/A71D/V831, E35D/T57A/A71D/L85Q, H18Y/A26T/E35D/A71D/L85Q, E35D/M47L, E23D/M42V/M431/158V/L70R, V68M/L70M/A71D/E95K, N55I/T57I/I69F, E35D/M43I/A71D, T41S/T57I/L70R, H18Y/A71D/L72P/E88V, V20I/A71D, E23G/A26S/E35D/T62N/A71D/L72V/L85M, A12T/E24D/E35D/D46V/I61V/L72P/E95V, V22L/E35D/M43L/A71G/D76H, E35G/K54E/A71D/L72P, L70Q/A71D, A26E/E35D/M47L/L85Q, D46E/A71D, Y31H/E35D/T41S/V68L/K93R/R94W, A26E/Q33R/E35D/M47L/L85Q/K86E, A26E/Q33R/E35D/M47L/L85Q, E35D/M47L/L85Q, A26E/Q33L/E35D/M47L/L85Q, A26E/Q33L/E35D/M47L, H18Y/A26E/Q33L/E35D/M47L/L85Q, Q33L/E35D/M47I, H18Y/Q33L/E35D/M471, Q33L/E35D/D46E/M47I, Q33R/E35D/D46E/M47I, H18Y/E35D/M47L, Q33L/E35D/M47V, Q33L/E35D/M47V/T79A, Q33L/E35D/T41S/M47V, Q33L/E35D/M47I/L85Q, Q33L/E35D/M47I/T62N/L85Q, Q33L/E35D/M47V/L85Q, A26E/E35D/M43T/M47L/L85Q/R94Q, Q33R/E35D/K37E/M47V/L85Q, V22A/E23D/Q33L/E35D/M47V, E24D/Q33L/E35D/M47V/K54R/L85Q, S15P/Q33L/E35D/M47L/L85Q, E7D/E35D/M47I/L97Q, Q33L/E35D/T41S/M43I, E35D/M47I/K54R/L85E, Q33K/E35D/D46V/L85Q, Y31S/E35D/M47L/T79L/E88G, H18L/V22A/E35D/M47L/N48T/L85Q, Q27H/E35D/M47L/L85Q/R94Q/E95K, Q33K/E35D/M47V/K89E/K93R, E35D/M47I/E77A/L85Q/R94W, A26E/E35D/M43I/M47L/L85Q/K86E/R94W, Q27H/Q33L/E35D/M47V/N55D/L85Q/K89N, H18Y/V20A/Q33L/E35D/M47V/Y53F, V22A/E35D/V68E/A71D, Q33L/E35D/M47L/A71G/F92S, V22A/R29H/E35D/D46E/M47I, Q33L/E35D/M43I/L85Q/R94W, H18Y/E35D/V68M/L97Q, Q33L/E35D/M47L/V68M/L85Q/E88D, Q33L/E35D/M43V/M47I/A71G, E35D/M47L/A71G/L97Q, E35D/M47V/A71G/L85M/L97Q, H18Y/Y31H/E35D/M47V/A71G/L85Q, E35D/D46E/M47V/L97Q, E35D/D46V/M47I/A71G/F92V, E35D/M47V/T62A/A71G/V83A/Y87H/L97M, Q33L/E35D/N48K/L85Q/L97Q, E35D/L85Q/K93T/E95V/L97Q, E35D/M47V/N48K/V68M/K89N, Q33L/E35D/M47I/N48D/A71G, R29H/E35D/M43V/M47I/I49V, Q27H/E35D/M47I/L85Q/D90G, E35D/M47I/L85Q/D90G, E35D/M47I/T62S/L85Q, A26E/E35D/M47L/A71G, E35D/M47I/Y87Q/K89E, V22A/E35D/M47I/Y87N, H18Y/A26E/E35D/M47L/L85Q/D90G, E35D/M47L/A71G/L85Q, E35D/M47V/A71G/E88D, E35D/A71G, E35D/M47V/A71G, 130V/E35D/M47V/A71G/A91V, I30V/Y31C/E35D/M47V/A71G/L85M, V22D/E35D/M47L/L85Q, H18Y/E35D/N48K, E35D/T41S/M47V/A71G/K89N, E35D/M47V/N48T/L85Q, E35D/D46E/M47V/A71D/D90G, E35D/D46E/M47V/A71D, E35D/T41S/M43I/A71G/D90G, E35D/T41S/M43I/M47V/A71G, E35D/T41S/M43I/M47L/A71G, H18Y/V22A/E35D/M47V/T62S/A71G, H18Y/A26E/E35D/M47L/V68M/A71G/D90G, E35D/K37E/M47V/N48D/L85Q/D90N, Q27H/E35D/D46V/M47L/A71G, V22L/Q27H/E35D/M47I/A71G, E35D/D46V/M47L/V68M/L85Q/E88D, E35D/T41S/M43V/M47I/L70M/A71G, E35D/D46E/M47V/N63D/L85Q, E35D/M47V/T62A/A71D/K93E, E35D/D46E/M47V/V68M/D90G/K93E, E35D/M43I/M47V/K89N, E35D/M47L/A71G/L85M/F92Y, E35D/M42V/M47V/E52D/L85Q, V22D/E35D/M47L/L70M/L97Q, E35D/T41S/M47V/L97Q, E35D/Y53H/A71G/D90G/L97R, E35D/A71D/L72V/R73H/E81K, Q33L/E35D/M43I/Y53F/T62S/L85Q, E35D/M38T/D46E/M47V/N48S, Q33R/E35D/M47V/N48K/L85M/F92L, E35D/M38T/M43V/M47V/N48R/L85Q, T28Y/Q33H/E35D/D46V/M47I/A71G, L70Q/A91G, L70Q/A91G/T130A, L70Q/A91G/II18A/T120S/T130A, V4M/L70Q/A91G/T120S/T130A, L70Q/A91G/T120S/T130A, V20L/L70Q/A91S/T120S/T130A, S44P/L70Q/A91G/T130A, L70Q/A91G/E117G/T120S/T130A, A91G/T120S/T130A, L70R/A91G/T120S/T130A, L70Q/E81A/A91G/T120S/I127T/T130A, L70Q/Y87N/A91G/T130A, T28S/L70Q/A91G/E95K/T120S/T130A, N63S/L70Q/A91G/T120S/T130A, K36E/I67T/L70Q/A91G/T120S/T130A/N152T, E52G/L70Q/A91G/T120S/T130A, K37E/F59S/L70Q/A91G/T120S/T130A, A91G/S103P, K89E/T130A, A91G, D60V/A91G/T120S/T130A, K54M/A91G/T120S, M38T/L70Q/E77G/A91G/T120S/T130A/N152T, R29H/E52G/L70R/E88G/A91G/T130A, Y31H/T41G/L70Q/A91G/T120S/T130A, V68A/T110A, S66H/D90G/T110A/F116L, R29H/E52G/T120S/T130A, A91G/L102S, I67T/L70Q/A91G/T120S, L70Q/A91G/T110A/T120S/T130A, M38V/T41D/M43I/W50G/D76G/V83A/K89E/T120S/T130A, V22A/L70Q/S121P, A12V/S15F/Y31H/T41G/T130A/P137L/N152T, 167F/L70R/E88G/A91G/T120S/T130A, E24G/L25P/L70Q/T120S, A91G/F92L/F108L/T120S, R29D/Y31L/Q33H/K36G/M38I/T41A/M43R/M47T/E81V/L85R/K89N/A91T/F92P/K93V/R94L/I118T/N149S, R29D/Y31L/Q33H/K36G/M38I/T41A/M43R/M47T/E81V/L85R/K89N/A91T/F92P/K93V/R94L/N144 S/N149S, R29D/Y31L/Q33H/K36G/M38I/T41A/M42T/M43R/M47T/E81V/L85R/K89N/A91T/F92P/K93V/R94L/L148S/N149S, E24G/R29D/Y31L/Q33H/K36G/M38I/T41A/M43R/M47T/F59L/E81V/L85R/K89N/A91T/F92P/K93V/R94L/H96R/N149S/C182S, R29D/Y31L/Q33H/K36G/M38I/T41A/M43R/M47T/E81V/L85R/K89N/A91T/F92P/K93V/R94L/N149 S, R29V/M43Q/E81R/L85I/K89R/D90L/A91E/F92N/K93Q/R94G, T41I/A91G, K89R/D90K/A91G/F92Y/K93R/N122S/N177S, K89R/D90K/A91G/F92Y/K93R, K36G/K37Q/M38I/F59L/E81V/L85R/K89N/A91T/F92P/K93V/R94L/E99G/T130A/N149S, E88D/K89R/D90K/A91G/F92Y/K93R, K36G/K37Q/M38I/L40M, K36G, R29H/Y31H/T41G/Y87N/E88G/K89E/D90N/A91G/P109S, A12T/H18L/M43V/F59L/E77K/P109S/I118T, R29V/Y31F/K36G/M38L/M43Q/E81R/V83I/L85I/K89R/D90L/A91E/F92N/K93Q/R94G, V68M/L70P/L72P/K86E, R29D/Y31L/Q33H/K36G/M38I/T41A/M43R/M47T/E81V/L85R/K89N/A91T/F92P/K93V/R94L/T120S/1127T/T130A/K169E, R29D/Y31L/Q33H/K36G/M38I/T41A/M43R/M47T/L70Q/E81V/L85R/K89N/A91T/F92P/K93V/R94L/T 120S/I127T/T130A, H18L/R29D/Y31L/Q33H/K36G/M38I/T41A/M43R/M47T/E81V/L85R/K89N/A91T/F92P/K93V/R94L/T 120S/I127T/T130A/K169E, R29D/Y31L/Q33H/K36G/M38I/T41A/M43R/M47T/E81V/L85R/K89N/A91T/F92P/K93V/R94L/T120S/T130A/M174T, R29D/Y31L/Q33H/K36G/M38I/T41A/M43R/M47T/F59L/E81V/L85R/K89N/A91T/F92P/K93V/R94L/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/T 120S/T130A/K169E/H188D, R29D/Y31L/Q33H/K36G/M38I/T41A/M43R/M47T/L70Q/E81V/L85R/K89N/A91T/F92P/K93V/R94L/T 120S/I127T/T130A/E143G/K169E/M174V/H188D, R29D/Y31L/Q33H/K36G/M38I/T41A/M43R/M47T/L70Q/E81V/L85R/K89N/A91T/F92P/K93V/R94L/T 120S/I127T/T130A, R29D/Y31L/Q33H/K36G/M38I/T41A/M43R/M47T/E81V/L85R/K89N/A91T/F92P/K93V/R94L/T120S/1127T/T130A/H188D, R29D/Y31L/Q33H/K36G/M38I/T41A/M43R/M47T/L70Q/E81V/L85R/K89N/A91T/F92P/K93V/R94L/T 120S/I127T/T130A/K169E, R29D/Y31L/Q33H/K36G/M38I/T41A/M43R/M47T/L70Q/E81V/L85R/K89N/A91T/F92P/K93V/R94L/T 120S/I127T/T130A, R29D/Y31L/Q33H/K36G/M38I/T41A/M43R/M47T/L85R/K89N/A91T/F92P/K93V/R94L/T120S/I127 T/T130A/K169E/H188D, R29D/Y31L/Q33H/K36G/M38I/T41A/M43R/M47T/E81V/L85R/K89N/A91T/F92P/K93V/R94L/F108L/T 120S/T130A/K169E/H188D, R29D/Y31L/Q33H/K36G/M38I/T41A/M43R/M47T/L70Q/E81V/L85R/K89N/A91T/F92P/K93V/R94L/T130A/H188D, R29D/Y31L/Q33H/K36G/M38I/T41A/M43R/M47T/L70Q/E81V/L85R/K89N/A91T/F92P/K93V/R94L/T 120S/I127T/T130A/K169E, H18L/R29D/Y31L/Q33H/K36G/M38I/T41A/M43R/M47T/L70Q/E81V/L85R/K89N/A91T/F92P/K93V/R94L/T 120S/T130A/K169E/H188D, R29D/Y31L/Q33H/K36G/M38I/T41A/M43R/M47T/E81V/L85R/K89N/A91T/F92P/K93V/R94L/T120S/1127T/C128Y/T130A/H188D, R29D/Y31L/Q33H/K36G/M38I/T41A/M43R/M47T/E81V/L85R/K89N/A91T/F92P/K93V/R94F/T130A/K169E, H18L/R29D/Y31L/Q33H/K36G/M38I/T41A/M43R/M47T/E81V/L85R/K89N/A91T/F92P/K93V/R94L/T130A, H18L/R29D/Y31L/Q33H/K36G/M38I/T41A/M43R/M47T/L70Q/E81V/L85R/K89N/A91T/F92P/K93V/R94L/T 120S/T130A/K169E, R29D/Y31L/Q33H/K36G/M38I/T41A/M43R/M47T/L70Q/E81V/L85R/K89N/A91T/F92P/K93I/R94L/L97R/T 130A, R29D/Y31L/Q33H/K36G/M38I/T41A/M43R/M47T/L70Q/E81V/L85R/K89N/A91T/F92P/K93I/R94L/L97R/T 130A/L148S, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/I61N/E81V/L85R/K89N/A91T/F92P/K93V/R94F/V 104A/T120S/T130A, R29D/Y31L/Q33H/K36G/M38I/T41A/M43R/M47T/E81V/L85R/K89N/F92P/K93V/R94F/I118V/T130A, R29D/Y31L/Q33H/K36G/M38I/T41A/M43R/M47T/T62S/E81V/L85R/K89N/A91T/F92P/K93V/R94L/I118V/T120S/T130A/K169E/T175A, H18L/R29D/Y31L/Q33H/K36G/M38I/T41A/M43R/M47T/E81V/L85R/K89N/A91T/F92P/K93V/R94L/F116S/T130A/H188D, H18L/R29D/Y31L/Q33H/K36G/M38I/T41A/M43R/M47T/E81V/L85R/K89N/A91T/F92P/K93V/R94L/T 120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T 110A/H188D, R29D/Y31L/Q33H/K36G/M38I/T41A/M43R/M47T/A91G/T120S/I127T/T130A/H188D, R29D/Y31L/Q33H/K36G/M38I/T41A/M43R/M47T/L70Q/D76G/A91G/S103L/T120S/I127T/T130A, DELTAQ33/Y53C/L85R/K89N/A91T/F92P/K93V/R94L/T120S/I127T/T130A/K169E, T62S/E81V/L85R/K89N/A91T/F92P/K93V/R94L/T120S/T130A/K169E, R29D/Y31L/Q33H/K36G/M38I/T41A/M43R/M47T/E81V/L85R/K89N/A91T/F92P/K93V/R94L/S129L/H188D, K9E/E10R/V11S/A12G/T13N/K14A/S15V/C16L/G17W/H18Y/Y53C/L70Q/D90G/T 130A/N149D/N152T/H188D, H18L/R29D/Y31L/Q33H/K36G/T41A/M43R/M47T/E81V/L85R/K89N/A91T/F92P/K93V/R94L/I118V/T 120S/I127T/T130A/H188D, K89E/K93E/T130A, S21P/R29D/Y31L/Q33H/K36G/M38I/T41A/M43R/M47T/N48I/V68A/E81V/L85R/K89N/A91T/F92P/K93V/R94L/P109H/I126L/K1691, H18L/R29D/Y31L/Q33H/K36G/M38I/T41A/M43R/M47T/P74L/Y80N/E81V/L85R/K89N/A91T/F92P/K93V/R94L/L97R, S21P/R29D/Y31L/Q33H/K36G/M38I/T41A/M43R/M47T/P74L/Y80N/E81V/L85R/K89N/D90N/A91T/F92P/K93V/R94L/T 130A/N149S/E162G, H18L/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/V68M/E81V/L85R/K89N/A91T/F92P/K93V/R94L/T130A/N149S/R190S, H18L/R29D/Y31L/Q33H/K36G/M38I/T41A/M43R/M47T/P74L/Y80N/E81V/L85R/K89N/A91T/F92P/K93V/R94L/T 130A/R190S, C16G/V22A/R29D/Y31L/Q33H/K36G/M38I/T41A/M43R/M47T/V68M/D76G/E81V/L85R/K89N/A91 T/F92P/K93V/R94L/I118 T/T130A/S140T/N149S/K169I/H178R/N192D, R29D/Y31L/Q33H/

K36G/M38I/T41A/M43R/M47T/E81V/L85R/K89N/A91T/F92P/K93V/R94F/E117V/I118T/N149S/S168G/H188Q, V22A/R29D/Y31L/Q33H/K36G/M38I/T41A/M43R/M47T/V68M/E81V/L85R/K89N/A91T/F92P/K93V/R94L/T130A, R29D/Y31L/Q33H/K36G/M38I/T41A/M43R/M47T/N64S/E81V/L85R/K89N/A91T/F92P/K93V/R94F/I118T/T130A/N149S/K1691, V22A/R29D/Y31L/Q33H/K36G/M38I/T41A/M43R/M47T/V68M/E81V/L85R/K89N/A91T/F92P/K93V/R94L/D115G/I118T/T130A/G133D/N149S, S129P, A91G/S129P, I69T/L70Q/A91G/T120S, Y31H/S129P, T28A/R29D/Y31L/Q33H/K36G/M38I/T41A/M43R/M47T/E81V/L85R/K89N/A91T/F92P/K93V/R94L/V 104L/T130A/N149S, H18L/R29D/Y31L/Q33H/K36G/M38I/T41A/M43R/M47T/E81V/L85R/K89N/A91T/F92P/K93V/R94L/L97R/N149S/H188Q, H18L/R29D/Y31L/Q33H/K36G/M38I/T41A/M43R/M47T/E81V/L85R/K89N/A91T/F92P/K93V/R94L/L97R/N149S, H18L/R29D/Y31L/Q33H/K36G/M38I/T41A/M43R/M47T/V68A/E81V/L85R/K89N/A91T/F92P/K93V/R94L/T130A/N149S/T154I, A12G/R29D/Y31L/Q33H/K36G/M38I/T41A/M43R/M47T/V68A/E81V/L85R/K89N/A91T/F92P/K93V/R94L/L97R/T130A/L183H, R29D/Y31L/Q33H/K36G/M38I/T41A/M43R/M47T/E81V/L85R/K89N/A91T/F92P/K93V/R94L/I118T/T130A/S140T/N149S/K169S, R29D/Y31L/Q33H/K36G/M38I/T41A/M43R/M47T/E81V/L85R/K89N/A91T/F92P/K93V/R94L/I118T/T130A/N149S/K169I/Q193L, V22A/R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S, R29D/Y31L/Q33H/K36G/M38I/T41A/M43R/M47T/E81V/L85R/K89N/A91T/F92P/K93V/R94L/I118T/T130A/N149S/K1691, R29D/Y31L/Q33H/K36G/M38I/T41A/M43R/M47T/E81V/L85R/K89N/A91T/F92P/K93V/R94F/T130A/N149S/K1691, I118T/C128R, Q27R/R29C/M42T/S129P/E160G, S129P/T154A, S21P/L70Q/D90G/T120S/T130A, L70Q/A91G/N144D, L70Q/A91G/I118A/T120S/T130A/K169E, V4M/L70Q/A91G/I118V/T120S/T130A/K169E, L70Q/A91G/I118V/T120S/T130A/K169E, L70Q/A91G/I118V/T120S/T130A, V20L/L70Q/A91S/I118V/T120S/T130A, L70Q/A91G/E117G/II18V/T120S/T130A, A91G/II18V/T120S/T130A, L70R/A91G/II18V/T120S/T130A/T199S, L70Q/E81A/A91G/I118V/T120S/I127T/T130A, T28S/L70Q/A91G/E95K/I118V/T120S/I126V/T130A/K169E, N63S/L70Q/A91G/S114T/II18V/T120S/T130A, K36E/I67T/L70Q/A91G/I118V/T120S/T130A/N152T, E52G/L70Q/A91G/D107N/I118V/T120S/T130A/K169E, K37E/F59S/L70Q/A91G/I118V/T120S/T130A/K185E, D60V/A91G/I118V/T120S/T130A/K169E, K54M/L70Q/A91G/Y164H/T120S, M38T/L70Q/E77G/A91G/I118V/T120S/T130A/N152T, Y31H/T41G/M43L/L70Q/A91G/I118V/T120S/I126V/T130A, L65H/D90G/T110A/F116L, R29H/E52G/D90N/I118V/T120S/T130A, I67T/L70Q/A91G/I118V/T120S, L70Q/A91G/T110A/II18V/T120S/T130A, M38V/T41D/M43I/W50G/D76G/V83A/K89E/I118V/T120S/I126V/T130A, A12V/S15F/Y31H/M38L/T41G/M43L/D90N/T130A/P137L/N149D/N152T, 167F/L70R/E88G/A91G/I118V/T120S/T130A, E24G/L25P/L70Q/A91G/I118V/T120S/N152T, A91G/F92L/F108L/I118V/T120S, E88D/K89R/D90K/A91G/F92Y/K93R/N122S/N177S, K36G/K37Q/M38I/L40M/F59L/E81V/L85R/K89N/A91T/F92P/K93V/R94L/E99G/T130A/N149S, K36G/L40M, R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/L85R/K89N/A91T/F92P/K93V/R94L/I118V/T120S/I127T/T130A, H18L/R29D/Y31L/Q33H/K36G/M38I/T41A/M43R/M47T/E81V/L85R/K89N/A91T/F92P/K93V/R94L/I118V/T120S/I127T/T130A/K169E, R29D/Y31L/Q33H/K36G/M38I/T41A/M43R/M47T/E81V/L85R/K89N/A91T/F92P/K93V/R94L/I118V/T120S/T130A/K169E/M174T, R29D/Y31L/Q33H/K36G/M38I/T41A/M43R/M47T/N48D/F59L/E81V/L85R/K89N/A91T/F92P/K93V/R94L/I118V/T120S/I127T/T130A/H188D, H18R/R29D/Y31L/Q33H/K36G/K37E/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/I127T/T130A/E143G/K169E/M174V/H188D, R29D/I30V/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/E81V/L85R/K89N/A91T/F92P/K93V/R94L/I118V/T120S/I127T/T130A/H188D, R29D/Y31L/Q33H/K36G/M38I/T41A/M43R/M47T/L70Q/E81V/L85R/K89N/A91T/F92P/K93V/R94L/I118V/T120S/I127T/T130A/K169E, R29D/Y31L/Q33H/K36G/M38I/T41A/M43R/M47T/L70Q/E81V/K89N/A91T/F92P/K93V/R94L/I118V/T120S/I127T/T130A, R29D/Y31L/Q33H/K36G/M38I/T41A/M43R/M47T/L85R/K89N/A91T/F92P/K93V/R94L/I118V/T120S/I127T/T130A/K169E/H188D, R29D/Y31L/Q33H/K36G/M38I/T41A/M43R/M47T/E81V/L85R/K89N/A91T/F92P/K93V/R94L/F108L/1118V/T120S/T130A/K169E/H188D, R29D/Y31L/Q33H/K36G/M38I/T41A/M43R/M47T/L70Q/E81V/L85R/K89N/A91T/F92P/K93V/R94L/I118V/T120S/T130A/N149D/K169E/H188D, H18L/R29D/Y31L/Q33H/K36G/M38I/T41A/M43R/M47T/L70Q/E81V/L85R/K89N/A91T/F92P/K93V/R94L/I118V/T120S/T130A/K169E/H188D, R29D/Y31L/Q33H/K36G/M38I/T41A/M43R/M47T/E81V/L85R/K89N/A91T/F92P/K93V/R94L/I118V/T120S/I127T/C128Y/T130A/H188D, H18L/R29D/Y31L/Q33H/K36G/M38I/T41A/M43R/M47T/E81V/L85R/K89N/A91T/F92P/K93V/R94L/E99D/T130A, H18L/R29D/Y31L/Q33H/K36G/M38I/T41A/M43R/M47T/L70Q/E81V/L85R/K89N/A91T/F92P/K93V/R94L/I118V/T120S/T130A/K169E, R29D/Y31L/Q33H/K36G/M38I/T41A/M43R/M47T/I61N/E81V/L85R/K89N/A91T/F92P/K93V/R94F/V104A/I118V/T120S/I126V/T130A, R29D/Y31L/Q33H/K36G/M38I/T41A/M43R/M47T/E81V/L85R/K89N/A91T/F92P/K93V/R94F/I118V/T120S/T130A, R29D/Y31L/Q33H/K36G/M38I/T41A/M43R/M47T/T62S/E81V/L85R/K89N/A91T/F92P/K93V/R94L/I118V/T120S/T130A/K169E/T175A, H18L/R29D/Y31L/Q33H/K36G/M38I/T41A/M43R/M47T/E81V/L85R/K89N/A91T/F92P/K93V/R94L/I118V/T120S/I127T/T130A/L142S/H188D, C16S/H18L/R29D/Y31L/Q33H/K36G/M38I/T41A/M43R/M47T/E81V/L85R/K89N/A91T/F92P/K93V/R94L/T110A/II18V/H188D, R29D/Y31L/Q33H/K36G/M38I/T41A/M43R/M47T/A91G/I118V/T120S/I127T/T130A/H188, R29D/Y31L/Q33H/K36G/M38I/T41A/M43R/M47T/L70Q/D76G/A91G/S103L/I118V/T120S/I127T/T130A, Y53C/L85R/K89N/A91T/F92P/K93V/R94L/I118V/T120S/I127T/T130A/K169E, T62S/E81V/L85R/K89N/A91T/F92P/K93V/R94L/I118V/T120S/T130A/K169E, Y53C/L70Q/D90G/T130A/N149D/N152T/H188D, H18L/R29D/Y31L/Q33H/K36G/M38I/T41A/M43R/M47T/E81V/L85R/K89N/A91T/F92P/K93V/R94L/I118V/T120S/I127T/T130A/H188D, and H18L/R29D/Y31L/Q33H/K36G/M38I/T41A/M43R/M47T/E81V/L85R/K89N/A91T/F92P/K93V/R94L/T130A/N149S.

In some embodiments, the ARBM is or an IgD (e.g. IgV) of wild-type CD80 set forth in Table 8 or a vIgD thereof comprising any of the modifications (e.g. substitutions) listed in Table 8. Table 8 also provides exemplary sequences by reference to SEQ ID NO for ARBMs containing an ECD or IgV domain of CD80. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of an ARBM, such as to ensure proper folding of the domain when expressed. Thus, it is understood that the exemplification of the SEQ ID NOS in Table 8 is not to be construed as limiting. For example, the particular domain, such as the ECD or IgV domain, can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the ARBM is or contains a wild-type CD80 ECD set forth in SEQ ID NO: 28 or a variant CD80 ECD sequence set forth in any one of SEQ ID NOS: 932-1004, 2656-2751. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any one of SEQ ID NOS: 932-1004, 2656-2751 and contains the amino acid modification(s), e.g., substitution(s), not present in the wild-type or unmodified CD80 ECD, e.g. not present in SEQ ID NO:28. In some embodiments, the ARBM is or contains a specific binding fragment of any of the ECD sequences set forth in any one of SEQ ID NOS: 932-1004, 2656-2751) and contains the amino acid modification(s), e.g., substitution(s), not present in the wild-type or unmodified CD80, e.g. not present in SEQ ID NO:28.

In some embodiments, the ARBM is or contains a wild-type CD80 IgV set forth in any one of SEQ ID NOs: 1005, 1079, 2615, 2654, or 3580 or a variant IgV sequence set forth in any one of SEQ ID NOS: 1006-1078, 1080-1152, 2752-2943. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 1006-1078, 1080-1152, 2752-2943 and contains the amino acid modification(s), e.g., substitution(s), not present in the wild-type or unmodified CD80, e.g. not present in SEQ ID NO: 1005, 2615, 2654, or 3580. In some embodiments, ARBM is or contains a specific binding fragment of any of the IgV set forth in any one of SEQ ID NOS: 77-149, 151-223, 2105-2296) and that contains the amino acid modification(s), e.g., substitution(s), not present in the wild-type or unmodified CD80, e.g. not present in SEQ ID NO: 1005, 2615 or 2654, or 3580.

TABLE 8

Exemplary CD80 ARBMs containing an IgD or vIgD

| Mutation(s) | ECD SEQ ID NO | IgV SEQ ID NO |
|---|---|---|
| Wild-type | 28 | 1005, 2615, 2654, 3580 |
| L70P | 932 | 1006, 1080 |
| I30F/L70P | 933 | 1007, 1081 |
| Q27H/T41S/A71D | 934 | 1008, 1082 |
| I30T/L70R | 935 | 1009, 1083 |
| T13R/C16R/L70Q/A71D | 936 | 1010, 1084 |
| T57I | 937 | 1011, 1085 |
| M43I/C82R | 938 | 1012, 1086 |
| V22L/M38V/M47T/A71D/L85M | 939 | 1013, 1087 |
| I30V/T57I/L70P/A71D/A91T | 940 | 1014, 1088 |
| V22I/L70M/A71D | 941 | 1015, 1089 |
| N55D/L70P/E77G | 942 | 1016, 1090 |
| T57A/I69T | 943 | 1017, 1091 |
| N55D/K86M | 944 | 1018, 1092 |
| L72P/T79I | 945 | 1019, 1093 |
| L70P/F92S | 946 | 1020, 1094 |
| T79P | 947 | 1021, 1095 |
| E35D/M47I/L65P/D90N | 948 | 1022, 1096 |
| L25S/E35D/M47I/D90N | 949 | 1023, 1097 |
| A71D | 951 | 1025, 1099 |
| E81K/A91S | 953 | 1027, 1101 |
| A12V/M47V/L70M | 954 | 1028, 1102 |
| K34E/T41A/L72V | 955 | 1029, 1103 |
| T41S/A71D/V84A | 956 | 1030, 1104 |
| E35D/A71D | 957 | 1031, 1105 |
| E35D/M47I | 958 | 1032, 1106 |
| K36R/G78A | 959 | 1033, 1107 |
| Q33E/T41A | 960 | 1034, 1108 |
| M47V/N48H | 961 | 1035, 1109 |
| M47L/V68A | 962 | 1036, 1110 |
| S44P/A71D | 963 | 1037, 1111 |
| Q27H/M43I/A71D/R73S | 964 | 1038, 1112 |
| E35D/T57I/L70Q/A71D | 966 | 1040, 1114 |
| M47I/E88D | 967 | 1041, 1115 |
| M42I/I61V/A71D | 968 | 1042, 1116 |
| P51A/A71D | 969 | 1043, 1117 |
| H18Y/M47I/T57I/A71G | 970 | 1044, I118 |

TABLE 8-continued

Exemplary CD80 ARBMs containing an IgD or vIgD

| Mutation(s) | ECD SEQ ID NO | IgV SEQ ID NO |
|---|---|---|
| V20I/M47V/T57I/V84I | 971 | 1045, 1119 |
| V20I/M47V/A71D | 972 | 1046, 1120 |
| A71D/L72V/E95K | 973 | 1047, 1121 |
| V22L/E35G/A71D/L72P | 974 | 1048, 1122 |
| E35D/A71D | 975 | 1049, 1123 |
| E35D/I67L/A71D | 976 | 1050, 1124 |
| Q27H/E35G/A71D/L72P/T79I | 977 | 1051, 1125 |
| T13R/M42V/M47I/A71D | 978 | 1052, 1126 |
| E35D | 979 | 1053, 1127 |
| E35D/M47I/L70M | 980 | 1054, 1128 |
| E35D/A71D/L72V | 981 | 1055, 1129 |
| E35D/M43L/L70M | 982 | 1056, 1130 |
| A26P/E35D/M43I/L85Q/E88D | 983 | 1057, 1131 |
| E35D/D46V/L85Q | 984 | 1058, 1132 |
| Q27L/E35D/M47I/T57I/L70Q/E88D | 985 | 1059, 1133 |
| M47V/I69F/A71D/V831 | 986 | 1060, 1134 |
| E35D/T57A/A71D/L85Q | 987 | 1061, 1135 |
| H18Y/A26T/E35D/A71D/L85Q | 988 | 1062, 1136 |
| E35D/M47L | 989 | 1063, 1137 |
| E23D/M42V/M43I/I58V/L70R | 990 | 1064, 1138 |
| V68M/L70M/A71D/E95K | 991 | 1065, 1139 |
| N55I/T57I/I69F | 992 | 1066, 1140 |
| E35D/M43I/A71D | 993 | 1067, 1141 |
| T41S/T57I/L70R | 994 | 1068, 1142 |
| H18Y/A71D/L72P/E88V | 995 | 1069, 1143 |
| V20I/A71D | 996 | 1070, 1144 |
| E23G/A26S/E35D/T62N/A71D/L72V/L85M | 997 | 1071, 1145 |
| A12T/E24D/E35D/D46V/I61V/L72P/E95V | 998 | 1072, 1146 |
| V22L/E35D/M43L/A71G/D76H | 999 | 1073, 1147 |
| E35G/K54E/A71D/L72P | 1000 | 1074, 1148 |
| L70Q/A71D | 1001 | 1075, 1149 |
| A26E/E35D/M47L/L85Q | 1002 | 1076, 1150 |
| D46E/A71D | 1003 | 1077, 1151 |
| Y31H/E35D/T41S/V68L/K93R/R94W | 1004 | 1078, 1152 |
| A26E/Q33R/E35D/M47L/L85Q/K86E | 2656 | 2752, 2848 |
| A26E/Q33R/E35D/M47L/L85Q | 2657 | 2753, 2849 |
| E35D/M47L/L85Q | 2658 | 2754, 2850 |
| A26E/Q33L/E35D/M47L/L85Q | 2659 | 2755, 2851 |
| A26E/Q33L/E35D/M47L | 2660 | 2756, 2852 |
| H18Y/A26E/Q33L/E35D/M47L/L85Q | 2661 | 2757, 2853 |
| Q33L/E35D/M47I | 2662 | 2758, 2854 |
| H18Y/Q33L/E35D/M47I | 2663 | 2759, 2855 |
| Q33L/E35D/D46E/M47I | 2664 | 2760, 2856 |
| Q33R/E35D/D46E/M47I | 2665 | 2761, 2857 |
| H18Y/E35D/M47L | 2666 | 2762, 2858 |
| Q33L/E35D/M47V | 2667 | 2763, 2859 |
| Q33L/E35D/M47V/T79A | 2668 | 2764, 2860 |
| Q33L/E35D/T41S/M47V | 2669 | 2765, 2861 |
| Q33L/E35D/M47I/L85Q | 2670 | 2766, 2862 |
| Q33L/E35D/M47I/T62N/L85Q | 2671 | 2767, 2863 |
| Q33L/E35D/M47V/L85Q | 2672 | 2768, 2864 |
| A26E/E35D/M43T/M47L/L85Q/R94Q | 2673 | 2769, 2865 |
| Q33R/E35D/K37E/M47V/L85Q | 2674 | 2770, 2866 |
| V22A/E23D/Q33L/E35D/M47V | 2675 | 2771, 2867 |
| E24D/Q33L/E35D/M47V/K54R/L85Q | 2676 | 2772, 2868 |
| S15P/Q33L/E35D/M47L/L85Q | 2677 | 2773, 2869 |
| E7D/E35D/M47I/L97Q | 2678 | 2774, 2870 |
| Q33L/E35D/T41S/M43I | 2679 | 2775, 2871 |
| E35D/M47I/K54R/L85E | 2680 | 2776, 2872 |
| Q33K/E35D/D46V/L85Q | 2681 | 2777, 2873 |
| Y31S/E35D/M47L/T79L/E88G | 2682 | 2778, 2874 |
| H18L/V22A/E35D/M47L/N48T/L85Q | 2683 | 2779, 2875 |
| Q27H/E35D/M47L/L85Q/R94Q/E95K | 2684 | 2780, 2876 |
| Q33K/E35D/M47V/K89E/K93R | 2685 | 2781, 2877 |
| E35D/M47I/E77A/L85Q/R94W | 2686 | 2782, 2878 |
| A26E/E35D/M43I/M47L/L85Q/K86E/R94W | 2687 | 2783, 2879 |
| Q27H/Q33L/E35D/M47V/N55D/L85Q/K89N | 2688 | 2784, 2880 |
| H18Y/V20A/Q33L/E35D/M47V/Y53F | 2689 | 2785, 2881 |
| V22A/E35D/V68E/A71D | 2690 | 2786, 2882 |
| Q33L/E35D/M47L/A71G/F92S | 2691 | 2787, 2883 |
| V22A/R29H/E35D/D46E/M47I | 2692 | 2788, 2884 |
| Q33L/E35D/M43I/L85Q/R94W | 2693 | 2789, 2885 |
| H18Y/E35D/V68M/L97Q | 2694 | 2790, 2886 |
| Q33L/E35D/M47L/V68M/L85Q/E88D | 2695 | 2791, 2887 |
| Q33L/E35D/M43V/M47I/A71G | 2696 | 2792, 2888 |

TABLE 8-continued

| Mutation(s) | ECD SEQ ID NO | IgV SEQ ID NO |
|---|---|---|
| Exemplary CD80 ARBMs containing an IgD or vIgD | | |
| E35D/M47L/A71G/L97Q | 2697 | 2793, 2889 |
| E35D/M47V/A71G/L85M/L97Q | 2698 | 2794, 2890 |
| H18Y/Y31H/E35D/M47V/A71G/L85Q | 2699 | 2795, 2891 |
| E35D/D46E/M47V/L97Q | 2700 | 2796, 2892 |
| E35D/D46V/M47I/A71G/F92V | 2701 | 2797, 2893 |
| E35D/M47V/T62A/A71G/V83A/Y87H/L97M | 2702 | 2798, 2894 |
| Q33L/E35D/N48K/L85Q/L97Q | 2703 | 2799, 2895 |
| E35D/L85Q/K93T/E95V/L97Q | 2704 | 2800, 2896 |
| E35D/M47V/N48K/V68M/K89N | 2705 | 2801, 2897 |
| Q33L/E35D/M47I/N48D/A71G | 2706 | 2802, 2898 |
| R29H/E35D/M43V/M47I/I49V | 2707 | 2803, 2899 |
| Q27H/E35D/M47I/L85Q/D90G | 2708 | 2804, 2900 |
| E35D/M47I/L85Q/D90G | 2709 | 2805, 2901 |
| E35D/M47I/T62S/L85Q | 2710 | 2806, 2902 |
| A26E/E35D/M47L/A71G | 2711 | 2807, 2903 |
| E35D/M47I/Y87Q/K89E | 2712 | 2808, 2904 |
| V22A/E35D/M47I/Y87N | 2713 | 2809, 2905 |
| H18Y/A26E/E35D/M47L/L85Q/D90G | 2714 | 2810, 2906 |
| E35D/M47L/A71G/L85Q | 2715 | 2811, 2907 |
| E35D/M47V/A71G/E88D | 2716 | 2812, 2908 |
| E35D/A71G | 2717 | 2813, 2909 |
| E35D/M47V/A71G | 2718 | 2814, 2910 |
| I30V/E35D/M47V/A71G/A91V | 2719 | 2815, 2911 |
| I30V/Y31C/E35D/M47V/A71G/L85M | 2720 | 2816, 2912 |
| V22D/E35D/M47L/L85Q | 2721 | 2817, 2913 |
| H18Y/E35D/N48K | 2722 | 2818, 2914 |
| E35D/T41S/M47V/A71G/K89N | 2723 | 2819, 2915 |
| E35D/M47V/N48T/L85Q | 2724 | 2820, 2916 |
| E35D/D46E/M47V/A71D/D90G | 2725 | 2821, 2917 |
| E35D/D46E/M47V/A71D | 2726 | 2822, 2918 |
| E35D/T41S/M43I/A71G/D90G | 2727 | 2823, 2919 |
| E35D/T41S/M43I/M47V/A71G | 2728 | 2824, 2920 |
| E35D/T41S/M43I/M47L/A71G | 2729 | 2825, 2921 |
| H18Y/V22A/E35D/M47V/T62S/A71G | 2730 | 2826, 2922 |
| H18Y/A26E/E35D/M47L/V68M/A71G/D90G | 2731 | 2827, 2923 |
| E35D/K37E/M47V/N48D/L85Q/D90N | 2732 | 2828, 2924 |
| Q27H/E35D/D46V/M47L/A71G | 2733 | 2829, 2925 |
| V22L/Q27H/E35D/M47I/A71G | 2734 | 2830, 2926 |
| E35D/D46V/M47L/V68M/L85Q/E88D | 2735 | 2831, 2927 |
| E35D/T41S/M43V/M47I/L70M/A71G | 2736 | 2832, 2928 |
| E35D/D46E/M47V/N63D/L85Q | 2737 | 2833, 2929 |
| E35D/M47V/T62A/A71D/K93E | 2738 | 2834, 2930 |
| E35D/D46E/M47V/V68M/D90G/K93E | 2739 | 2835, 2931 |
| E35D/M43I/M47V/K89N | 2740 | 2836, 2932 |
| E35D/M47L/A71G/L85M/F92Y | 2741 | 2837, 2933 |
| E35D/M42V/M47V/E52D/L85Q | 2742 | 2838, 2934 |
| V22D/E35D/M47L/L70M/L97Q | 2743 | 2839, 2935 |
| E35D/T41S/M47V/L97Q | 2744 | 2840, 2936 |
| E35D/Y53H/A71G/D90G/L97R | 2745 | 2841, 2937 |
| E35D/A71D/L72V/R73H/E81K | 2746 | 2842, 2938 |
| Q33L/E35D/M43I/Y53F/T62S/L85Q | 2747 | 2843, 2939 |
| E35D/M38T/D46E/M47V/N48S | 2748 | 2844, 2940 |
| Q33R/E35D/M47V/N48K/L85M/F92L | 2749 | 2845, 2941 |
| E35D/M38T/M43V/M47V/N48R/L85Q | 2750 | 2846, 2942 |
| T28Y/Q33H/E35D/D46V/M47I/A71G | 2751 | 2847, 2943 |
| L70Q/A91G | 3244 | 3299, 3477 |
| L70Q/A91G/T130A | 3245 | |
| L70Q/A91G/I118A/T120S/T130A | 3246 | |
| V4M/L70Q/A91G/T120S/T130A | 3247 | 3300 |
| L70Q/A91G/T120S/T130A | 3248 | |
| V20L/L70Q/A91S/T120S/T130A | 3249 | 3301 |
| S44P/L70Q/A91G/T130A | 3250 | 3302 |
| L70Q/A91G/E117G/T120S/T130A | 3251 | |
| A91G/T120S/T130A | 3252 | 3303 |
| L70R/A91G/T120S/T130A | 3253 | 3304 |
| L70Q/E81A/A91G/T120S/I127T/T130A | 3254 | 3305 |
| L70Q/Y87N/A91G/T130A | 3255 | 3306 |
| T28S/L70Q/A91G/E95K/T120S/T130A | 3256 | 3307 |
| N63S/L70Q/A91G/T120S/T130A | 3257 | 3308 |
| K36E/I67T/L70Q/A91G/T120S/T130A/N152T | 3258 | 3309 |
| E52G/L70Q/A91G/T120S/T130A | 3259 | 3310 |
| K37E/F59S/L70Q/A91G/T120S/T130A | 3260 | 3311 |
| A91G/S103P | 3261 | 3481 |
| K89E/T130A | 3262 | 3312, 3488 |
| A91G | 3263 | 3300, 3478 |

TABLE 8-continued

Exemplary CD80 ARBMs containing an IgD or vIgD

| Mutation(s) | ECD SEQ ID NO | IgV SEQ ID NO |
|---|---|---|
| D60V/A91G/T120S/T130A | 3264 | 3313 |
| K54M/A91G/T120S | 3265 | 3314 |
| M38T/L70Q/E77G/A91G/T120S/T130A/N152T | 3266 | 3315 |
| R29H/E52G/L70R/E88G/A91G/T130A | 3267 | 3316 |
| Y31H/T41G/L70Q/A91G/T120S/T130A | 3268 | 3317 |
| V68A/T110A | 3269 | 3318 |
| S66H/D90G/T110A/F116L | 3270 | 3319 |
| R29H/E52G/T120S/T130A | 3271 | 3320 |
| A91G/L102S | 3272 | 3489 |
| I67T/L70Q/A91G/T120S | 3273 | 3321 |
| L70Q/A91G/T110A/T120S/T130A | 3274 | |
| M38V/T41D/M43I/W50G/D76G/V83A/K89E/T120S/T130A | 3275 | 3322 |
| V22A/L70Q/S121P | 3276 | 3323 |
| A12V/S15F/Y31H/T41G/T130A/P137L/N152T | 3277 | 3324 |
| I67F/L70R/E88G/A91G/T120S/T130A | 3278 | 3325 |
| E24G/L25P/L70Q/T120S | 3279 | 3326 |
| A91G/F92L/F108L/T120S | 3280 | 3327 |
| R29D/Y31L/Q33H/K36G/M38I/T41A/M43R/M47T/E81V/L85R/K89N/A91T/F92P/K93V/R94L/I118T/N149S | 3281 | 3328 |
| R29D/Y31L/Q33H/K36G/M38I/T41A/M43R/M47T/E81V/L85R/K89N/A91T/F92P/K93V/R94L/N144S/N149S | 3282 | |
| R29D/Y31L/Q33H/K36G/M38I/T41A/M42T/M43R/M47T/E81V/L85R/K89N/A91T/F92P/K93V/R94L/L148S/N149S | 3283 | 3329 |
| E24G/R29D/Y31L/Q33H/K36G/M38I/T41A/M43R/M47T/F59L/E81V/L85R/K89N/A91T/F92P/K93V/R94L/H96R/N149S/C182S | 3284 | 3330 |
| R29D/Y31L/Q33H/K36G/M38I/T41A/M43R/M47T/E81V/L85R/K89N/A91T/F92P/K93V/R94L/N149S | 3285 | |
| R29V/M43Q/E81R/L85I/K89R/D90L/A91E/F92N/K93Q/R94G | 3286 | 3331, 3479 |
| T41I/A91G | 3287 | 3332, 3480 |
| K89R/D90K/A91G/F92Y/K93R/N122S/N177S | 3288 | |
| K89R/D90K/A91G/F92Y/K93R | 3289 | 3333, 3476 |
| K36G/K37Q/M38I/F59L/E81V/L85R/K89N/A91T/F92P/K93V/R94L/E99G/T130A/N149S | 3290 | 3334 |
| E88D/K89R/D90K/A91G/F92Y/K93R | 3291 | 3335, 3482 |
| K36G/K37Q/M38I/L40M | 3292 | 3336, 3483 |
| K36G | 3293 | 3337, 3484 |
| R29H/Y31H/T41G/Y87N/E88G/K89E/D90N/A91G/P109S | 3294 | 3338 |
| A12T/H18L/M43V/F59L/E77K/P109S/I118T | 3295 | 3339 |
| R29V/Y31F/K36G/M38L/M43Q/E81R/V83I/L85I/K89R/D90L/A91E/F92N/K93Q/R94G | 3296 | 3340, 3485 |
| V68M/L70P/L72P/K86E | 3297 | 3341, 3486 |
| R29D/Y31L/Q33H/K36G/M38I/T41A/M43R/M47T/E81V/L85R/K89N/A91T/F92P/K93V/R94L/T120S/I127T/T130A/K169E | 3342 | |
| R29D/Y31L/Q33H/K36G/M38I/T41A/M43R/M47T/L70Q/E81V/L85R/K89N/A91T/F92P/K93V/R94L/T120S/I127T/T130A | 3343 | |
| H18L/R29D/Y31L/Q33H/K36G/M38I/T41A/M43R/M47T/E81V/L85R/K89N/A91T/F92P/K93V/R94L/T120S/I127T/T130A/K169E | 3344 | |
| R29D/Y31L/Q33H/K36G/M38I/T41A/M43R/M47T/E81V/L85R/K89N/A91T/F92P/K93V/R94L/T120S/T130A/M174T | 3345 | |
| R29D/Y31L/Q33H/K36G/M381/T41A/M43R/M47T/F59L/E81V/L85R/K89N/A91T/F92P/K93V/R94L/T120S/I127T/T130A/H188D | 3346 | |
| H18R/R29D/Y31L/Q33H/K36G/K37E/M381/T41A/M43R/M47T/L70Q/E81V/L85R/K89N/A91T/F92P/K93V/R94L/T120S/T130A/K169E/H188D | 3347 | |
| R29D/Y31L/Q33H/K36G/M38I/T41A/M43R/M47T/L70Q/E81V/L85R/K89N/A91T/F92P/K93V/R94L/T120S/I127T/T130A/E143G/K169E/M174V/H188D | 3348 | |
| R29D/Y31L/Q33H/K36G/M38I/T41A/M43R/M47T/L70Q/E81V/L85R/K89N/A91T/F92P/K93V/R94L/T120S/I127T/T130A | 3349 | |
| R29D/Y31L/Q33H/K36G/M38I/T41A/M43R/M47T/E81V/L85R/K89N/A91T/F92P/K93V/R94L/T120S/I127T/T130A/H188D | 3350 | |
| R29D/Y31L/Q33H/K36G/M38I/T41A/M43R/M47T/L70Q/E81V/L85R/K89N/A91T/F92P/K93V/R94L/T120S/I127T/T130A/K169E | 3351 | |
| R29D/Y31L/Q33H/K36G/M38I/T41A/M43R/M47T/L70Q/E81V/L85R/K89N/A91T/F92P/K93V/R94L/T120S/I127T/T130A | 3352 | |
| R29D/Y31L/Q33H/K36G/M381/T41A/M43R/M47T/L85R/K89N/A91T/F92P/K93V/R94L/T120S/I127T/T130A/K169E/H188D | 3353 | |
| R29D/Y31L/Q33H/K36G/M38I/T41A/M43R/M47T/E81V/L85R/K89N/A91T/F92P/K93V/R94L/F108L/T120S/T130A/K169E/H188D | 3354 | |
| R29D/Y31L/Q33H/K36G/M38I/T41A/M43R/M47T/L70Q/E81V/L85R/K89N/A91T/F92P/K93V/R94L/T130A/H188D | 3355 | |
| R29D/Y31L/Q33H/K36G/M38I/T41A/M43R/M47T/L70Q/E81V/L85R/K89N/A91T/F92P/K93V/R94L/T120S/I127T/T130A/K169E | 3356 | |
| H18L/R29D/Y31L/Q33H/K36G/M38I/T41A/M43R/M47T/L70Q/E81V/L85R/K89N/A91T/F92P/K93V/R94L/T120S/T130A/K169E/H188D | 3357 | |
| R29D/Y31L/Q33H/K36G/M38I/T41A/M43R/M47T/E81V/L85R/K89N/A91T/F92P/K93V/R94L/T120S/I127T/C128Y/T130A/H188D | 3358 | |

TABLE 8-continued

| Exemplary CD80 ARBMs containing an IgD or vIgD | | |
|---|---|---|
| Mutation(s) | ECD SEQ ID NO | IgV SEQ ID NO |
| R29D/Y31L/Q33H/K36G/M38I/T41A/M43R/M47T/E81V/L85R/K89N/A91T/F92P/K93V/R94F/T130A/K169E | 3359 | |
| H18L/R29D/Y31L/Q33H/K36G/M38I/T41A/M43R/M47T/E81V/L85R/K89N/A91T/F92P/K93V/R94L/T130A | 3360 | |
| H18L/R29D/Y31L/Q33H/K36G/M38I/T41A/M43R/M47T/L70Q/E81V/L85R/K89N/A91T/F92P/K93V/R94L/T120S/T130A/K169E | 3361 | |
| R29D/Y31L/Q33H/K36G/M38I/T41A/M43R/M47T/L70Q/E81V/L85R/K89N/A91T/F92P/K93I/R94L/L97R/T130A | 3362 | |
| R29D/Y31L/Q33H/K36G/M38I/T41A/M43R/M47T/L70Q/E81V/L85R/K89N/A91T/F92P/K93I/R94L/L97R/T130A/L148S | 3363 | |
| H18L/R29D/Y31L/Q33H/K36G/M38I/T41A/M43R/M47T/E81V/L85R/K89N/A91T/F92P/K93V/R94L/I118V/T120S/I127T/T130A/K169E | 3364 | |
| R29D/Y31L/Q33H/K36G/M38I/T41A/M43R/M47T/I61N/E81V/L85R/K89N/A91T/F92P/K93V/R94F/V104A/T120S/T130A | 3365 | |
| R29D/Y31L/Q33H/K36G/M38I/T41A/M43R/M47T/E81V/L85R/K89N/F92P/K93V/R94F/I118V/T130A | 3366 | |
| R29D/Y31L/Q33H/K36G/M38I/T41A/M43R/M47T/T62S/E81V/L85R/K89N/A91T/F92P/K93V/R94L/I118V/T120S/T130A/K169E/T175A | 3367 | |
| H18L/R29D/Y31L/Q33H/K36G/M38I/T41A/M43R/M47T/E81V/L85R/K89N/A91T/F92P/K93V/R94L/F116S/T130A/H188D | 3368 | |
| H18L/R29D/Y31L/Q33H/K36G/M38I/T41A/M43R/M47T/E81V/L85R/K89N/A91T/F92P/K93V/R94L/T120S/I127T/T130A/L142S/H188D | 3369 | |
| C16S/H18L/R29D/Y31L/Q33H/K36G/M38I/T41A/M43R/M47T/E81V/L85R/K89N/A91T/F92P/K93V/R94L/T110A/H188D | 3370 | |
| R29D/Y31L/Q33H/K36G/M38I/T41A/M43R/M47T/A91G/T120S/I127T/T130A/H188D | 3371 | |
| R29D/Y31L/Q33H/K36G/M38I/T41A/M43R/M47T/L70Q/D76G/A91G/S103L/T120S/I127T/T130A | 3372 | |
| DELTAQ33/Y53C/L85R/K89N/A91T/F92P/K93V/R94L/T120S/I127T/T130A/K169E | 3373 | |
| T62S/E81V/L85R/K89N/A91T/F92P/K93V/R94L/T120S/T130A/K169E | 3374 | |
| R29D/Y31L/Q33H/K36G/M38I/T41A/M43R/M47T/E81V/L85R/K89N/A91T/F92P/K93V/R94L/S129L/H188D | 3375 | |
| K9E/E10R/V11S/A12G/T13N/K14A/S15V/C16L/G17W/H18Y/Y53C/L70Q/D90G/T130A/N149D/N152T/H188D | 3376 | |
| H18L/R29D/Y31L/Q33H/K36G/T41A/M43R/M47T/E81V/L85R/K89N/A91T/F92P/K93V/R94L/I118V/T120S/I127T/T130A/H188D | 3377 | |
| K89E/K93E/T130A | 3378 | |
| S21P/R29D/Y31L/Q33H/K36G/M38I/T41A/M43R/M47T/N48I/V68A/E81V/L85R/K89N/A91T/F92P/K93V/R94L/P109H/I126L/K169I | 3379 | |
| H18L/R29D/Y31L/Q33H/K36G/M38I/T41A/M43R/M47T/P74L/Y80N/E81V/L85R/K89N/A91T/F92P/K93V/R94L/L97R | 3380 | 3409, 3487 |
| S21P/R29D/Y31L/Q33H/K36G/M38I/T41A/M43R/M47T/P74L/Y80N/E81V/L85R/K89N/D90N/A91T/F92P/K93V/R94L/T130A/N149S/E162G | 3381 | |
| H18L/R29D/Y31L/Q33H/K36G/M38I/T41A/M43R/M47T/V68M/E81V/L85R/K89N/A91T/F92P/K93V/R94L/T130A | 3382 | |
| R29D/Y31L/Q33H/K36G/M38I/T41A/M43R/M47T/V68M/E81V/L85R/K89N/A91T/F92P/K93V/R94L/T130A/N149S/R190S | 3383 | |
| H18L/R29D/Y31L/Q33H/K36G/M38I/T41A/M43R/M47T/P74L/Y80N/E81V/L85R/K89N/A91T/F92P/K93V/R94L/T130A/R190S | 3384 | |
| C16G/V22A/R29D/Y31L/Q33H/K36G/M38I/T41A/M43R/M47T/V68M/D76G/E81V/L85R/K89N/A91T/F92P/K93V/R94L/I118T/T130A/S140T/N149S/K169I/H178R/N192D | 3385 | |
| R29D/Y31L/Q33H/K36G/M38I/T41A/M43R/M47T/E81V/L85R/K89N/A91T/F92P/K93V/R94F/E117V/I118T/N149S/S168G/H188Q | 3386 | |
| V22A/R29D/Y31L/Q33H/K36G/M381/T41A/M43R/M47T/V68M/E81V/L85R/K89N/A91T/F92P/K93V/R94L/T130A | 3387 | |
| R29D/Y31L/Q33H/K36G/M38I/T41A/M43R/M47T/N64S/E81V/L85R/K89N/A91T/F92P/K93V/R94F/I118T/T130A/N149S/K169I | 3388 | |
| V22A/R29D/Y31L/Q33H/K36G/M381/T41A/M43R/M47T/V68M/E81V/L85R/K89N/A91T/F92P/K93V/R94L/D115G/I118T/T130A/G133D/N149S | 3389 | |
| S129P | 3390 | |
| A91G/S129P | 3391 | |
| I69T/L70Q/A91G/T120S | 3392 | |
| Y31H/S129P | 3393 | |
| T28A/R29D/Y31L/Q33H/K36G/M38I/T41A/M43R/M47T/E81V/L85R/K89N/A91T/F92P/K93V/R94L/V104L/T130A/N149S | 3394 | |
| H18L/R29D/Y31L/Q33H/K36G/M38I/T41A/M43R/M47T/E81V/L85R/K89N/A91T/F92P/K93V/R94L/L97R/N149S/H188Q | 3395 | |
| H18L/R29D/Y31L/Q33H/K36G/M38I/T41A/M43R/M47T/E81V/L85R/K89N/A91T/F92P/K93V/R94L/L97R/N149S | 3396 | |
| H18L/R29D/Y31L/Q33H/K36G/M38I/T41A/M43R/M47T/V68A/E81V/L85R/K89N/A91T/F92P/K93V/R94L/T130A/N149S/T1541 | 3397 | |

TABLE 8-continued

| Exemplary CD80 ARBMs containing an IgD or vIgD | | |
|---|---|---|
| Mutation(s) | ECD SEQ ID NO | IgV SEQ ID NO |
| A12G/R29D/Y31L/Q33H/K36G/M381/T41A/M43R/M47T/V68A/E81V/L85R/K89N/A91T/F92P/K93V/R94L/L97R/T130A/L183H | 3398 | |
| R29D/Y31L/Q33H/K36G/M38I/T41A/M43R/M47T/E81V/L85R/K89N/A91T/F92P/K93V/R94L/I118T/T130A/S140T/N149S/K169S | 3399 | |
| R29D/Y31L/Q33H/K36G/M38I/T41A/M43R/M47T/E81V/L85R/K89N/A91T/F92P/K93V/R94L/I118T/T130A/N149S/K1691/Q193L | 3400 | |
| V22A/R29D/Y31L/Q33H/K36G/M381/T41A/M43R/M47T/E81V/L85R/K89N/A91T/F92P/K93V/R94L/I118T/T130A/N149S | 3401 | |
| R29D/Y31L/Q33H/K36G/M38I/T41A/M43R/M47T/E81V/L85R/K89N/A91T/F92P/K93V/R94L/I118T/T130A/N149S | 3402 | |
| R29D/Y31L/Q33H/K36G/M38I/T41A/M43R/M47T/E81V/L85R/K89N/A91T/F92P/K93V/R94L/I118T/T130A/N149S/K1691 | 3403 | |
| R29D/Y31L/Q33H/K36G/M38I/T41A/M43R/M47T/E81V/L85R/K89N/A91T/F92P/K93V/R94F/T130A/N149S/K1691 | 3404 | |
| I118T/C128R | 3405 | |
| Q27R/R29C/M42T/S129P/E160G | 3406 | |
| S129P/T154A | 3407 | |
| S21P/L70Q/D90G/T120S/T130A | 3408 | |
| L70Q/A91G/N144D | 3410 | |
| L70Q/A91G/I118A/T120S/T130A/K169E | 3411 | |
| V4M/L70Q/A91G/I118V/T120S/T130A/K169E | 3412 | |
| L70Q/A91G/I118V/T120S/T130A/K169E | 3413 | |
| L70Q/A91G/I118V/T120S/T130A | 3414 | |
| V20L/L70Q/A91S/I118V/T120S/T130A | 3415 | |
| L70Q/A91G/E117G/I118V/T120S/T130A | 3416 | |
| A91G/I118V/T120S/T130A | 3417 | |
| L70R/A91G/I118V/T120S/T130A/T199S | 3418 | |
| L70Q/E81A/A91G/I118V/T120S/I127T/T130A | 3419 | |
| T28S/L70Q/A91G/E95K/I118V/T120S/I126V/T130A/K169E | 3420 | |
| N63S/L70Q/A91G/S114T/I118V/T120S/T130A | 3421 | |
| K36E/I67T/L70Q/A91G/I118V/T120S/T130A/N152T | 3422 | |
| E52G/L70Q/A91G/D107N/I118V/T120S/T130A/K169E | 3423 | |
| K37E/F59S/L70Q/A91G/I118V/T120S/T130A/K185E | 3424 | |
| D60V/A91G/I118V/T120S/T130AK169E | 3425 | |
| K54M/L70Q/A91G/Y164H/T120S | 3426 | |
| M38T/L70Q/E77G/A91G/I118V/T120S/T130A/N152T | 3427 | |
| Y31H/T41G/M43L/L70Q/A91G/I118V/T120S/I126V/T130A | 3428 | |
| L65H/D90G/T110A/F116L | 3429 | |
| R29H/E52G/D90N/I118V/T120S/T130A | 3430 | |
| I67T/L70Q/A91G/I118V/T120S | 3432 | |
| L70Q/A91G/T110A/I118V/T120S/T130A | 3433 | |
| M38V/T41D/M43I/W50G/D76G/V83A/K89E/I118V/T120S/I126V/T130A | 3434 | |
| A12V/S15F/Y31H/M38L/T41G/M43L/D90N/T130A/P137L/N149D/N152T | 3435 | |
| I67F/L70R/E88G/A91G/I118V/T120S/T130A | 3436 | |
| E24G/L25P/L70Q/A91G/I118V/T120S/N152T | 3437 | |
| A91G/F92L/F108L/I118V/T120S | 3438 | |
| E88D/K89R/D90K/A91G/F92Y/K93R/N122S/N177S | 3439 | |
| K36G/K37Q/M38I/L40M/F59L/E81V/L85R/K89N/A91T/F92P/K93V/R94L/E99G/T130A/N149S | 3440 | |
| K36G/L40M | 3441 | 476, 477 |
| R29D/Y31L/Q33H/K36G/M38I/T41A/M43R/M47T/E81V/L85R/K89N/A91T/F92P/K93V/R94L/I118V/T120S/I127T/T130A/K169E | 3442 | |
| R29D/Y31L/Q33H/K36G/M38I/T41A/M43R/M47T/L70Q/E81V/L85R/K89N/A91T/F92P/K93V/R94L/I118V/T120S/I127T/T130A | 3443 | |
| H18L/R29D/Y31L/Q33H/K36G/M38I/T41A/M43R/M47T/E81V/L85R/K89N/A91T/F92P/K93V/R94L/I118V/T120S/I127T/T130A/K169E | 3444 | |
| R29D/Y31L/Q33H/K36G/M381/T41A/M43R/M47T/E81V/L85R/K89N/A91T/F92P/K93V/R94L/I118V/T120S/T130A/K169E/M174T | 3445 | |
| R29D/Y31L/Q33H/K36G/M38I/T41A/M43R/M47T/N48D/F59L/E81V/L85R/K89N/A91T/F92P/K93V/R94L/I118V/T120S/I127T/T130A/H188D | 3446 | |
| H18R/R29D/Y31L/Q33H/K36G/K37E/M381/T41A/M43R/M47T/L70Q/E81V/L85R/K89N/A91T/F92P/K93V/R94L/I118V/T120S/T130A/K169E/H188D | 3447 | |
| R29D/Y31L/Q33H/K36G/M38I/T41A/M43R/M47T/L70Q/E81V/L85R/K89N/A91T/F92P/K93V/R94L/I118V/T120S/I127T/T130A/E143G/K169E/M174V/H188D | 3448 | |
| R29D/I30V/Y31L/Q33H/K36G/M38I/T41A/M43R/M47T/E81V/L85R/K89N/A91T/F92P/K93V/R94L/I118V/T120S/I127T/T130A/H188D | 3449 | |
| R29D/Y31L/Q33H/K36G/M38I/T41A/M43R/M47T/E81V/L85R/K89N/A91T/F92P/K93V/R94L/I118V/T120S/I127T/T130A/H188D | 3450 | |
| R29D/Y31L/Q33H/K36G/M38I/T41A/M43R/M47T/L70Q/E81V/L85R/K89N/A91T/F92P/K93V/R94L/I118V/T120S/I127T/T130A/K169E | 3451 | |
| R29D/Y31L/Q33H/K36G/M38I/T41A/M43R/M47T/L70Q/E81V/K89N/A91T/F92P/K93V/R94L/I118V/T120S/I127T/T130A | 3452 | |
| R29D/Y31L/Q33H/K36G/M38I/T41A/M43R/M47T/L85R/K89N/A91T/F92P/K93V/R94L/I118V/T120S/I127T/T130A/K169E/H188D | 3453 | |

TABLE 8-continued

| Exemplary CD80 ARBMs containing an IgD or vIgD | | |
|---|---|---|
| Mutation(s) | ECD SEQ ID NO | IgV SEQ ID NO |
| R29D/Y31L/Q33H/K36G/M38I/T41A/M43R/M47T/E81V/L85R/K89N/A91T/F92P/K93V/R94L/F108L/I118V/T120S/T130A/K169E/H188D | 3454 | |
| R29D/Y31L/Q33H/K36G/M38I/T41A/M43R/M47T/L70Q/E81V/L85R/K89N/A91T/F92P/K93V/R94L/I118V/T120S/T130A/N149D/K169E/H188D | 3455 | |
| H18L/R29D/Y31L/Q33H/K36G/M38I/T41A/M43R/M47T/L70Q/E81V/L85R/K89N/A91T/F92P/K93V/R94L/I118V/T120S/T130A/K169E/H188D | 3456 | |
| R29D/Y31L/Q33H/K36G/M38I/T41A/M43R/M47T/E81V/L85R/K89N/A91T/F92P/K93V/R94L/I118V/T120S/I127T/C128Y/T130A/H188D | 3457 | |
| H18L/R29D/Y31L/Q33H/K36G/M38I/T41A/M43R/M47T/E81V/L85R/K89N/A91T/F92P/K93V/R94L/E99D/T130A | 3458 | |
| H18L/R29D/Y31L/Q33H/K36G/M38I/T41A/M43R/M47T/L70Q/E81V/L85R/K89N/A91T/F92P/K93V/R94L/I118V/T120S/T130A/K169E | 3459 | |
| R29D/Y31L/Q33H/K36G/M38I/T41A/M43R/M47T/I61N/E81V/L85R/K89N/A91T/F92P/K93V/R94F/V104A/I118V/T120S/I126V/T130A | 3460 | |
| R29D/Y31L/Q33H/K36G/M38I/T41A/M43R/M47T/E81V/L85R/K89N/A91T/F92P/K93V/R94F/I118V/T120S/T130A | 3461 | |
| R29D/Y31L/Q33H/K36G/M38I/T41A/M43R/M47T/T62S/E81V/L85R/K89N/A91T/F92P/K93V/R94L/I118V/T120S/T130A/K169E/T175A | 3462 | |
| H18L/R29D/Y31L/Q33H/K36G/M38I/T41A/M43R/M47T/E81V/L85R/K89N/A91T/F92P/K93V/R94L/I118V/T120S/I127T/T130A/L142S/H188D | 3463 | |
| C16S/H18L/R29D/Y31L/Q33H/K36G/M38I/T41A/M43R/M47T/E81V/L85R/K89N/A91T/F92P/K93V/R94L/T110A/I18V/H188D | 3464 | |
| R29D/Y31L/Q33H/K36G/M38I/T41A/M43R/M47T/A91G/I118V/T120S/I127T/T130A/H188D | 3465 | |
| R29D/Y31L/Q33H/K36G/M38I/T41A/M43R/M47T/L70Q/D76G/A91G/S103L/I118V/T120S/I127T/T130A | 3466 | |
| Y53C/L85R/K89N/A91T/F92P/K93V/R94L/I118V/T120S/I127T/T130A/K169E | 3467 | |
| T62S/E81V/L85R/K89N/A91T/F92P/K93V/R94L/I118V/T120S/T130A/K169E | 3468 | |
| Y53C/L70Q/D90G/T130A/N149D/N152T/H188D | 3469 | |
| H18L/R29D/Y31L/Q33H/K36G/M38I/T41A/M43R/M47T/E81V/L85R/K89N/A91T/F92P/K93V/R94L/I118V/T120S/I127T/T130A/H188D | 3470 | |
| H18L/R29D/Y31L/Q33H/K36G/M38I/T41A/M43R/M47T/E81V/L85R/K89N/A91T/F92P/K93V/R94L/T130A/N149S | 3471 | |

c. CD86 IgD or vIgD

Provided herein are immunomodulatory proteins containing an ARBM that is or contains one or more IgD, such as a wild-type or unmodified IgD or a vIgD, of CD86. In some embodiments, the ARBM is not the full length sequence of the CD86. In some aspects, the ARBM is a soluble polypeptide, is not membrane-expressed and/or lacks the transmembrane and/or cytoplasmic domain of CD86. In some embodiments, the ARBM only contains an extracellular domain (ECD) or a specific binding fragment thereof containing a IgD or vIgD, such as only contains an IgV domain or an IgC domain or specific binding fragment thereof, or combinations thereof.

In some embodiments, the ARBM is or contains the ECD sequence set forth in SEQ ID NO:29 or a specific binding fragment thereof. In some embodiments, the ARBM is or contains an IgV sequence set forth in SEQ ID NO: 1195, or is a specific binding fragment thereof.

(SEQ ID NO: 29)

```
APLKIQAYFNETADLPCQFANSQNQSLSELVVFWQD

QENLVLNEVYLGKEKFDSVHSKYMGRTSFDSDSWTL

RLHNLQIKDKGLYQCIIHHKKPTGMIRIHQMNSELS

VLANFSQPEIVPISNITENVYINLTCSSIHGYPEPK

KMSVLLRTKNSTIEYDGVMQKSQDNVTELYDVSISL

SVSFPDVTSNMTIFCILETDKTRLLSSPFSIELEDP

QPPPDHIP
```

-continued (SEQ ID NO: 1195)

```
APLKIQAYFNETADLPCQFANSQNQSLSELVVFWQD

QENLVLNEVYLGKEKFDSVHSKYMGRTSFDSDSWTL

RLHNLQIKDKGLYQCIIHHKKPTGMIRIHQMNSELS
```

In some embodiments, the immunomodulatory protein contains an ARBM that is or contains a vIgD containing one or more amino acid modifications, e.g. substitutions, in an IgD of a wild-type or unmodified CD86. In some embodiments, modifications provided herein can be in an ARBM containing an unmodified IgD set forth in SEQ ID NO: 29 or 1195 or in a sequence that has 85%, 85%, 87%, 88%, 89%, 90%, 91%, 92%, 93%, 94%, 95%, 96%, 97%, 98%, 99% or more sequence identity to SEQ ID NO: 29 or 1195. In some embodiments, an ARBM containing a vIgD of CD86 has at least about 85%, 86%, 86%, 88%, 89%, 90%, 91%, 92%, 93%, 94%, 95%, 96%, 97%, 98%, or 99% sequence identity with the sequence set forth in any of SEQ ID NO: 29 or 1195.

In some embodiments, the ARBM is or contains a vIgD that is an affinity-modified IgSF domain that has an increased binding activity, such as binding affinity, for CD28 relative to the binding activity of the wild-type or unmodified IgD for CD28. In some embodiments, the increase in binding activity, e.g. binding affinity, for CD28 is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions).

In some embodiments, the equilibrium dissociation constant ($K_d$) of the ARBM to CD28 can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less. In some embodiments, the ARBM binds to CD28 with a $K_d$ of from or from about 100 pm to 5000 pm, 100 pm to 2000 pm, 100 pm to 1500 pm, 100 pm to 1000 pm, 100 pm to 800 pm, 100 pm to 500 pm, 100 pm to 400 pm, 400 pm to 4000 pm, 400 pm to 2000 pm, 400 pm to 1500 pm, 400 pm to 1000 pm, 400 pm to 800 pm, 400 pm to 500 pm, 500 pm to 5000 pm, 500 pm to 2000 pm, 500 pm to 1500 pm, 500 pm to 1000 pm, 500 pm to 800 pm, 800 pm to 5000 pm, 800 pm to 2000 pm, 800 pm to 1500 pm, 800 pm to 1000 pm, 1000 pm to 5000 pm, 1000 pm to 2000 pm, 1000 pm to 1500 pm, 1500 pm to 5000 pm, 1500 to 2000 pm to 2000 pm to 50000 pm. In some embodiments, the ABRM binds to CD28 with a $K_d$ of less than 200 pM, 300 pM, 400 pM, 500 pM. In some embodiments, the ABRM binds to CD28 with a $K_d$ of greater than or greater than about 500 pm but less than or less than about 2000 pm, such as from or from about 500 pm to 1500 pm, 500 pm to 1250 pm, 500 pm to 1000 pm, 500 pm to 750 pm, 750 pm to 1500 pm, 750 pm to 1250 pm, 750 pm to 1000 pm, 1000 pm to 2000 pm, 1000 pm to 1500 pm or 1500 pm to 2000 pm.

Unless stated otherwise, the amino acid modification(s) present in a vIgD of a CD86 ECD or an IgD (e.g. IgV) thereof are designated by amino acid position number corresponding to the numbering of positions of the unmodified ECD sequence set forth in SEQ ID NO:29 or, where applicable, the unmodified IgV sequence set forth in SEQ ID NO: 1195. It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs: 29 or 1195. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a “del” is indicated and if the modification is an insertion at the position an “ins” is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the ARBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified CD86. In some embodiments, the one or more amino acid modifications, e.g. substitutions, are in the ECD domain of CD86 or a specific binding fragment thereof. In some embodiments, the one or more amino acid modifications, e.g. substitutions, are in the IgV domain of CD86 or a specific binding fragment thereof. In some embodiments, the one or more amino acid modifications, e.g. substitutions, are in an IgC domain of CD80 or a specific binding fragment thereof. In some embodiments, the one or more amino acid modifications, e.g. substitutions, are in the IgV domain of CD86 or a specific binding fragment thereof and in an IgC domain or domains of CD86 or a specific binding fragment thereof.

In some embodiments, the ARBM is or contains a vIgD that has one or more amino acid modifications (e.g., substitutions) in an unmodified IgD of CD86 or specific binding fragment thereof corresponding to position(s) 35, 90, and/or 102 with reference to numbering of SEQ ID NO: 29 or 1195. In some embodiments, the ARBM is or contains a vIgD of CD86 that one or more amino acid modifications (e.g., substitutions) from among Q35H, H90L, and/or Q102H or a conservative amino acid substitution thereof. In some embodiments, the one or more amino acid modification(s), e.g. substitution(s), is Q35H/H90L/Q102H.

In some embodiments, the ARBM is or contains an IgD (e.g. IgV) of wild-type CD86 set forth in Table 9 or a vIgD thereof comprising any of the modifications (e.g. substitutions) listed in Table 9. Table 9 also provides exemplary sequences by reference to SEQ ID NO for ARBMs containing an ECD or IgV domain of CD86. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of an ARBM, such as to ensure proper folding of the domain when expressed. Thus, it is understood that the exemplification of the SEQ ID NOS in Table 9 is not to be construed as limiting. For example, the particular domain, such as the ECD or IgV domain, can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the ARBM is or contains a wild-type CD86 ECD set forth in SEQ ID NO: 29 or a variant CD86 ECD set forth in any one of SEQ ID NOS: 1191-1194. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any one of SEQ ID NOS: 1191-1194 and contains the amino acid modification(s), e.g., substitution(s), not present in the wild-type or unmodified CD86, e.g. not present in SEQ ID NO:29. In some embodiments, the ARBM is or contains a specific binding fragment of any of the ECD sequences set forth in any one of SEQ ID NOS: 1191-1194 and that contains the amino acid modification(s), e.g., substitution(s), not present in the wild-type or unmodified CD86, e.g. not present in SEQ ID NO:29.

In some embodiments, the ARBM is or contains a wild-type CD86 IgV set forth in SEQ ID NO: 1195 or a variant IgV sequence set forth in any one of SEQ ID NOS: 1196-1199. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 1196-1199 and contains the amino acid modification(s), e.g., substitution(s), not present in the wild-type or unmodified CD86, e.g. not present in SEQ ID NO:1195. In some embodiments, the ARBM is or contains a specific binding fragment of any of the IgV sequences set forth in any one of SEQ ID NOS: 1196-1199 and that contains the amino acid modification(s), e.g., substitution(s), not present in the wildtype or unmodified CD86, e.g. not present in the sequence set forth in SEQ ID NO:1195.

TABLE 9

Exemplary CD86 ARBMs containing an IgD or vIgD

| Mutation(s) | ECD SEQ ID NO | IgV SEQ ID NO |
|---|---|---|
| Wild-type | 29 | 1195 |
| Q35H/H90L/Q102H | 1191 | 1196 |
| Q35H | 1192 | 1197 |
| H90L | 1193 | 1198 |
| Q102H | 1194 | 1199 |

2. CD2 Binding Molecules

Provided herein are immunomodulatory proteins containing an ARBM that is or contains a binding molecule that binds to CD2, such as to human CD2. In some embodiments, the ARBM of the immunomodulatory protein binds to the ectodomain of CD2. In some embodiments, the ARBM binds to CD2 on the surface of a cell, such as on the surface of a T cell.

In some embodiments, the provided immunomodulatory protein contains an ARBM that is or contains an antibody that binds CD2 or is an antigen-binding antibody fragment thereof (e.g. Fab or scFv). In some embodiments, the antibody or antigen-binding fragment binds to CD2, such as to human CD2. In some embodiments, the antibody is a single chain variable fragment (e.g. scFv) containing a VH and VL of an anti-CD2 antibody or antigen-binding fragment.

In some embodiments, the ARBM is or contains one or more IgD(s) or a specific binding fragment thereof, such as an unmodified or wild-type IgD or a vIgD or a specific binding fragment thereof, of an IgSF family member that bind CD2. In some embodiments, the CD2 is human CD2. Exemplary IgSF family members that bind to CD2 include LFA-3 (CD58) and CD48.

In some embodiments, the ARBM is or contains one or more IgD that is an IgD, or a vIgD thereof, of an LFA-3 polypeptide, such as a wild-type LFA-3, e.g. a human LFA-3. In some embodiments, the ARBM is not the full length sequence of the LFA-3. In some aspects, the ARBM is a soluble polypeptide, is not membrane-expressed and/or lacks the transmembrane and/or cytoplasmic domain of LFA-3. In some embodiments, the ARBM only contains an extracellular domain (ECD) or a specific binding fragment thereof containing a IgD or vIgD, such as only contains an IgV domain or an IgC domain or specific binding fragment thereof, or combinations thereof.

In some embodiments, the ARBM is or contains the ECD sequence set forth in SEQ ID NO:3239 or is a specific binding fragment thereof. In some embodiments, the ARBM is or contains an IgD (e.g. IgV or IgC) sequence of LFA-3, such as human LFA-3. In some embodiments, the ARBM is or contains an IgD sequence set forth in SEQ ID NO:2946, or is a specific binding fragment thereof. In some embodiments, the ARBM is or contains an IgD sequence set forth in SEQ ID NO:3650, or is a specific binding fragment thereof.

(SEQ ID NO: 3239)
FSQQIYGVVYGNVTFHVPSNVPLKEVLWKKQKDKVA

ELENSEFRAFSSFKNRVYLDTVSGSLTIYNLTSSDE

DEYEMESPNITDTMKFFLYVLESLPSPTLTCALTNG

-continued

SIEVQCMIPEHYNSHRGLIMYSWDCPMEQCKRNSTS

IYFKMENDLPQKIQCTLSNPLFNTTSSIILTTCIPS

SGHSRHR (SEQ ID NO: 2946)
SQQIYGVVYGNVTFHVPSNVPLKEVLWKKQKDKVAE

LENSEFRAFSSFKNRVYLDTVSGSLTIYNLTSSDED

EYEMESPNITDTMKFFLYVL (SEQ ID NO: 3650)
SQQIYGVVYGNVTFHVPSNVPLKEVLWKKQKDKVAE

LENSEFRAFSSFKNRVYLDTVSGSLTIYNLTSSDED

EYEMESPNITDTMKFFLYVLES

In some aspects, the ARBM contains one or more IgD that is an vIgD containing one or more amino acid modifications (e.g., substitutions, deletions or additions) compared to an IgD of a wild-type or unmodified LFA-3, which, in some aspects, result in increased binding of the ARBM to CD2. In some embodiments, modifications provided herein can be in an ARBM containing an unmodified IgD set forth in SEQ ID NO:3239 or 2946 or 3650 or in a sequence that has 85%, 85%, 87%, 88%, 89%, 90%, 91%, 92%, 93%, 94%, 95%, 96%, 97%, 98%, 99% or more sequence identity to SEQ ID NO: 3239 or 2946 or 3650. In some embodiments, an ARBM containing a vIgD of LFA-3 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 3239 or 2946 or 3650.

In some embodiments, the ARBM is or contains one or more IgD that is an IgD, or a vIgD thereof, of a CD48 polypeptide, such as a wild-type CD48, e.g. a human CD48. In some embodiments, the ARBM is not the full length sequence of the CD48. In some aspects, the ARBM is a soluble polypeptide, is not membrane-expressed and/or lacks the GPI anchor or is mutated in the GPI anchoring moiety (e.g. residue S220) of CD48, e.g. set forth in SEQ ID NO:3493. In some embodiments, the ARBM only contains an IgD or vIgD, or a specific binding fragment thereof, such as only contains an IgC domain or specific binding fragment thereof, or combinations thereof.

In some embodiments, the ARBM is or contains the sequence set forth in SEQ ID NO:3493 or is a specific binding fragment thereof. In some embodiments, the ARBM is or contains an IgD (e.g. IgC) sequence of CD48, such as human CD48. In some embodiments, the ARBM is or contain an IgD (e.g. IgC) sequence set forth as amino acid residues 29-127 of SEQ ID NO:3493, or is a specific binding fragment thereof. In some embodiments, the ARBM is or contain an IgD (e.g. IgC) sequence set forth as amino acid residues 132-212 of SEQ ID NO:3493, or is a specific binding fragment thereof.

(SEQ ID NO: 3493)
QGHLVHMTVVSGSNVTLNISESLPENYKQLTWFYTF

DQKIVEWDSRKSKYFESKFKGRVRLDPQSGALYISK

VQKEDNSTYIMRVLKKTGNEQEWKIKLQVLDPVPKP

-continued

VIKIEKIEDMDDNCYLKLSCVIPGESVNYTWYGDKR

PFPKELQNSVLETTLMPHNYSRCYTCQVSNSVSSKN

GTVCLSPPCTLARS

In some aspects, the ARBM contains one or more IgD that is an vIgD containing one or more amino acid modifications (e.g., substitutions, deletions or additions) compared to an IgD of a wild-type or unmodified CD48, which, in some aspects, result in increased binding of the ARBM to CD2. In some embodiments, modifications provided herein can be in an ARBM containing the sequence set forth in SEQ ID NO:3493 or in an IgC domain or specific binding fragment thereof, or in a sequence that has 85%, 85%, 87%, 88%, 89%, 90%, 91%, 92%, 93%, 94%, 95%, 96%, 97%, 98%, 99% or more sequence identity to SEQ ID NO: 3493 or in an IgC domain or specific binding fragment thereof. In some embodiments, an ARBM containing a vIgD of CD48 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 3493 or in an IgC domain or specific binding fragment thereof 3. CD3 Binding Molecules Provided herein are immunomodulatory proteins containing an ARBM that is or contains a binding molecule that binds to CD3, such as to human CD3. In some embodiments, the ARBM of the immunomodulatory protein binds to the ectodomain of CD3. In some embodiments, the ARBM binds to CD3 on the surface of a cell, such as on the surface of a T cell.

In some embodiments, the provided immunomodulatory polypeptides contain an ARBM that is or contains an antibody that binds CD3 or is an antigen-binding fragment thereof (e.g. Fab or scFv). In some embodiments, the antibody or antigen-binding fragment binds to CD3, such as to human CD3. In some embodiments, the antibody is a single chain variable fragment (e.g. scFv) containing a VH and VL of an anti-CD3 antibody or antigen-binding fragment. In some aspects, the anti-CD3 antibody is OKT3 or a fragment thereof, or is an antigen binding fragment containing a VH chain region and/or VL chain region of OKT3. In some embodiments, the anti-CD3 antibody has the sequence set forth in SEQ ID NO:2522 or has at least about 85%, 86%, 86%, 88%, 89%, 90%, 91%, 92%, 93%, 94%, 95%, 96%, 97%, 98%, or 99% sequence identity with the amino acid sequence of SEQ ID NO: 2522.

4. CD4 Binding Molecules

Provided herein are immunomodulatory proteins containing an ARBM that is or contains a binding molecule that binds to CD4, such as to human CD4. In some embodiments, the ARBM of the immunomodulatory protein binds to the ectodomain of CD4. In some embodiments, the ARBM binds to CD4 on the surface of a cell, such as on the surface of a T cell.

In some embodiments, the provided immunomodulatory protein contains an ARBM that is or contains an antibody that binds CD4 or is an antigen-binding antibody fragment thereof (e.g. Fab or scFv). In some embodiments, the antibody or antigen-binding fragment binds to CD4, such as to human CD4. In some embodiments, the antibody is a single chain variable fragment (e.g. scFv) containing a VH and VL of an anti-CD4 antibody or antigen-binding fragment.

In some embodiments, the ARBM is or contains interleukin-16 (IL-16; Uniprot accession number Q14005) or a portion thereof that binds to CD4. In some embodiments, the IL-16 or portion thereof is mammalian, such as is human. In some embodiments, the IL-16 polypeptide is a mature IL-16 polypeptide and/or has a sequence of a processed pro-IL-16. In some aspects, the ARBM is or contains residues 1212-1332 of a wild-type or unmodified pro-IL-16, e.g. human pro-IL-16. In some embodiments, the ARBM is or contains the sequence set forth in SEQ ID NO: 2521 or has at least about 85%, 86%, 86%, 88%, 89%, 90%, 91%, 92%, 93%, 94%, 95%, 96%, 97%, 98%, or 99% sequence identity with the sequence set forth in SEQ ID NO: 2521.

5. Ligands of Activating Receptor a. Ligand of CD80 or CD86, e.g. CTLA-4 IgD or vIgD Provided herein are immunomodulatory proteins containing an ARBM that is or contains a ligand an activating receptor. In some aspects, the activating receptor is CD28, e.g. human CD28, and/or the ligand of the activating receptor is CD80 or CD86, e.g. human CD80 or human CD86. In some embodiments, the ARBM of the immunomodulatory protein binds to the ectodomain of CD80 or CD86. In some embodiments, the ARBM binds to CD80 or CD86 on the surface of a cell, such as on the surface of an APC.

In some embodiments, the ARBM is an antibody that binds CD80 or CD86 or is an antigen-binding antibody fragment thereof (e.g. Fab or scFv). In some embodiments, the antibody or antigen-binding antibody fragment binds human CD80 or human CD86. In some embodiments, the antibody is a single chain variable fragment (e.g. scFv) containing a VH and VL of an anti-CD80 antibody or antigen-binding fragment or an anti-CD86 antibody or antigen-binding fragment.

In some embodiments, the ARBM is or contains an IgD (e.g. IgV) or a specific binding fragment thereof, such as an unmodified or wild-type IgD or a vIgD or a specific binding fragment thereof, of an IgSF family member that binds CD80 or CD86, such as human CD80 or human CD86. In some embodiments, the ARBM is or contains one or more IgD that is an IgD, or a vIgD thereof, of a CTLA-4 polypeptide, such as a wild-type CTLA-4, e.g. a human CTLA-4. In some aspects, the ARBM contains one or more IgD (e.g. IgV) that is an vIgD containing one or more amino acid modifications (e.g., substitutions, deletions or additions) compared to an IgD of a wild-type or unmodified CTLA-4, which, in some aspects, result in increased binding of the ARBM to CD80 or CD86. Exemplary IgDs or vIgDs of CTLA-4 binding partners for inclusion as an ARBM in the provided immunomodulatory proteins are described. In some embodiments, the ARBM is or contains a vIgD polypeptide that exhibit increased binding activity, such as binding affinity, for CD80 or CD86 compared to a corresponding wild-type or unmodified IgD.

CTLA-4 has been exploited as a therapeutic drug for treating autoimmune disease by attenuating T cell activation through modulation of CD80 and/or CD86 interactions. Specifically, Abatacept and Belatacept are FDA approved therapeutics for use in rheumatoid arthritis and transplant setting, respectively. Abatacept is wild-type CTLA-4 IgSF domain fused to an Fc portion of an antibody. Belatacept is a modified variant of CTLA-4 IgSF domain, containing a substitution of tyrosine for the alanine at position 31 and a glutamic acid for the leucine at position 106 (A31Y/L106E), corresponding to positions 31 and 106 of the wild-type reference CTLA-4 ECD sequence set forth in SEQ ID NO:36, to confer increased affinity toward CD80 and CD86 ligands (Kremer et al., *N Engl J Med.* 2003; 349(20):1907-1915; Larsen et al, *Am J Transplant.* 2005; 5(3):443-453).

In some embodiments, the ARBM is not the full length sequence of the CTLA-4. In some aspects, the ARBM is a soluble polypeptide, is not membrane-expressed and/or lacks the transmembrane and/or cytoplasmic domain of CTLA-4. In some embodiments, the ARBM only contains an extracellular domain (ECD) or a specific binding fragment thereof containing a IgD or vIgD, such as only contains an IgV domain or an IgC domain or specific binding fragment thereof, or combinations thereof.

In some embodiments, the ARBM is or contains the ECD sequence set forth in SEQ ID NO:36 or 2655 or is a specific binding fragment thereof. In some embodiments, the ARBM is or contains an IgD (e.g. IgV) sequence of CTLA-4, such as human CTLA-4. In some embodiments, the ARBM is or contain an IgD (e.g. IgV) sequence set forth in SEQ ID NO:2947, or is a specific binding fragment thereof.

(SEQ ID NO: 36)
KAMHVAQPAVVLASSRGIASFVCEYASPGKATEVRV
TVLRQADSQVTEVCAATYMMGNELTFLDDSICTGTS
SGNQVNLTIQGLRAMDTGLYICKVELMYPPPYYLGI
GNGTQIYVIDPEPCPDSD (SEQ ID NO: 2655)
KAMHVAQPAVVLASSRGIASFVCEYASPGKATEVRV
TVLRQADSQVTEVCAATYMMGNELTFLDDSICTGTS
SGNQVNLTIQGLRAMDTGLYICKVELMYPPPYYLGI
GNGTQIYVIDPEPCPDSDQ (SEQ ID NO: 2947)
HVAQPAVVLASSRGIASFVCEYASPGKATEVRVTVL
RQADSQVTEVCAATYMMGNELTFLDDSICTGTSSGN
QVNLTIQGLRAMDTGLYICKVELMYPPPYY

In some embodiments, the immunomodulatory protein contains an ARBM that is or contains a vIgD containing one or more amino acid modifications, e.g. substitutions, in an IgD of a wild-type or unmodified CTLA-4. In some embodiments, modifications provided herein can be in an ARBM containing an unmodified IgD set forth in SEQ ID NO: 36, 2655 or 2947 or in a sequence that has 85%, 85%, 87%, 88%, 89%, 90%, 91%, 92%, 93%, 94%, 95%, 96%, 97%, 98%, 99% or more sequence identity to SEQ ID NO: 36, 2655 or 2947. In some embodiments, an ARBM containing a vIgD of CTLA-4 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 36, 2655 or 2947.

In some embodiments, the ARBM is or contains a vIgD that is an affinity-modified IgSF domain that has an increased binding activity, such as binding affinity, for CD80 or CD86 relative to the binding activity of the wild-type or unmodified IgD for CD80 or CD86. In some embodiments, the increase in binding activity, e.g. binding affinity, for CD80 or CD86 is increased at least about 5%, such as at least about 10%, 15%, 20%, 25%, 35%, 50%, 75%, 100%, 200% or more. In some embodiments, the increase in binding activity, e.g. binding affinity, is more than 1.2-fold, 1.5-fold, 2-fold, 3-fold, 4-fold, 5-fold, 6-fold, 7-fold, 8-fold, 9-fold, 10-fold, 20-fold, 30-fold 40-fold, or 50-fold. In such examples, the wild-type or unmodified IgD has the same sequence as the vIgD except that it does not contain the one or more amino acid modifications (e.g. substitutions).

In some embodiments, the equilibrium dissociation constant ($K_d$) of the ARBM to CD80 or CD86 can be less than $1\times10^{-5}$M, $1\times10^{-6}$ M, $1\times10^{-7}$ M, $1\times10^{-8}$ M, $1\times10^{-9}$ M, $1\times10^{-10}$ M or $1\times10^{-11}$M, or $1\times10^{-12}$ M or less. In some embodiments, the ARBM binds to CD80 or CD86 with a $K_d$ of from or from about 100 pm to 5000 pm, 100 pm to 2000 pm, 100 pm to 1500 pm, 100 pm to 1000 pm, 100 pm to 800 pm, 100 pm to 500 pm, 100 pm to 400 pm, 400 pm to 4000 pm, 400 pm to 2000 pm, 400 pm to 1500 pm, 400 pm to 1000 pm, 400 pm to 800 pm, 400 pm to 500 pm, 500 pm to 5000 pm, 500 pm to 2000 pm, 500 pm to 1500 pm, 500 pm to 1000 pm, 500 pm to 800 pm, 800 pm to 5000 pm, 800 pm to 2000 pm, 800 pm to 1500 pm, 800 pm to 1000 pm, 1000 pm to 5000 pm, 1000 pm to 2000 pm, 1000 pm to 1500 pm, 1500 pm to 5000 pm, 1500 to 2000 pm to 2000 pm to 50000 pm. In some embodiments, the ABRM binds to CD80 or CD86 with a $K_d$ of less than 200 pM, 300 pM, 400 pM, 500 pM. In some embodiments, the ABRM binds to CD80 or CD86 with a $K_d$ of greater than or greater than about 500 pm but less than or less than about 2000 pm, such as from or from about 500 pm to 1500 pm, 500 pm to 1250 pm, 500 pm to 1000 pm, 500 pm to 750 pm, 750 pm to 1500 pm, 750 pm to 1250 pm, 750 pm to 1000 pm, 1000 pm to 2000 pm, 1000 pm to 1500 pm or 1500 pm to 2000 pm.

Unless stated otherwise, the amino acid modification(s) present in a vIgD of a CTLA-4 ECD or an IgD (e.g. IgV) thereof are designated by amino acid position number corresponding to the numbering of positions of the unmodified ECD sequence set forth in SEQ ID NO:36 or 2655. It is within the level of a skilled artisan to identify the corresponding position of a modification, e.g. amino acid substitution, in an ECD or a portion thereof containing an IgSF domain (e.g. IgV) thereof, such as by alignment of a reference sequence with SEQ ID NOs: 36 or 2655. In the listing of modifications throughout this disclosure, the amino acid position is indicated in the middle, with the corresponding unmodified (e.g. wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding unmodified (e.g. wild-type) amino acid listed before and after the number and the identified variant amino acid insertion listed after the unmodified (e.g. wild-type) amino acid.

In some embodiments, the ARBM contains a vIgD that has up to 1, 2, 3, 4, 5, 6, 7, 8, 9, 10, 11, 12, 13, 14, 15, 16, 17, 18, 19, or 20 amino acid modifications, e.g. substitutions. The one or more amino acid modifications, e.g. substitutions, can be in the ectodomain (extracellular domain) of the wild-type or unmodified CTLA-4. In some embodiments, the one or more amino acid modifications, e.g. substitutions, are in the ECD domain of CTLA-4 or a specific binding fragment thereof. In some embodiments, the one or more amino acid modifications, e.g. substitutions, are in the IgV domain of CTLA-4 or a specific binding fragment thereof. In some embodiments, the one or more amino acid modifications, e.g. substitutions, are in an IgC domain of CTLA-4 or a specific binding fragment thereof. In some embodiments, the one or more amino acid modifications, e.g. substitutions, are in the IgV domain of CTLA-4 or a specific binding fragment thereof and in an IgC domain or domains of CTLA-4 or a specific binding fragment thereof.

In some embodiments, the ARBM is or contains a vIgD that has one or more amino modification, e.g. substitutions, in an unmodified IgD of CTLA-4 or specific binding fragment thereof corresponding to position(s) 6, 10, 12, 14, 15, 16, 18, 19, 20, 22, 24, 26, 27, 28, 29, 30, 31, 33, 35, 37, 38, 41, 42, 43, 45, 46, 47, 48, 53, 54, 55, 56, 58, 59, 61, 63, 64, 65, 67, 69, 71, 72, 73, 75, 76, 82, 85, 86, 87, 89, 91, 93, 95, 96, 97, 98, 99, 105, 106, 108, 110, 113, 115, 116, 117, 118, 119, 120, 121, 122, 124, 125 and/or 126 with reference to positions set forth in SEQ ID NO:36.

In some embodiments, the ARBM contains a vIgD that has one or more amino acid modification, e.g. substitutions, in an unmodified CTLA-4 or specific binding fragment thereof corresponding to position(s) 12, 18, 26, 29, 31, 53, 56, 58, 63, 72, 98, 99, 105, 106, and/or 117 with reference to positions set forth in SEQ ID NO:36 or 2655. In some embodiments, the ARBM is or contains a vIgD of CTLA-4 that has one or more amino acid modifications selected from L12F, L12H, L12P, I18A, I18F, I18N, I18T, I18V, A26D, A26S, A26T, G29R, G29W, A31Y, T53S, M56K, M56L, M56R, M56T, M56V, N58D, N58S, L63H, L63P, S72G, S72T, L98Q, L98R, M99I, M99L, Y105F, Y105L, L106E, L106I, L106R, I117E, I117L, I117M, and/or I117T, or a conservative amino acid substitution thereof.

In some embodiments, the ARBM is or contains a vIgD of CTLA-4 that has one or more amino acid modifications selected from A6T, V10A, L12F, L12H, L12I, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, A31Y, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V96I, E97Q, L98Q, L98R, M99I, M99L, Y105F, Y105L, L106E, L106I, L106N, L106R, L106V, I108F, I108V, N110K, N110S, N110Y, Q113H, Y115H, Y115N, V116A, I117E, I117K, I117L, I117M, I117T, P119H, E120D, P121S, C122P, D124P, D1241, S1251, S125P, D126P, and/or D126T, or a conservative amino acid substitution thereof. In some embodiments, the the ARBM is or contains a vIgD that has one or more amino acid modification from L12F, L12H, L12I, L12P, I18A, I18F, I18N, I18T, I18V, A26D, A26S, A26T, G29R, G29W, E33M, E33V, T53S, M55R, M55T, M55V, M56K, M56L, M56R, M56T, M56V, N58D, N58S, L63H, L63P, S72G, S72T, M87A, M87K, M87T, M87V, L98Q, L98R, M99I, M99L, Y105F, Y105L, L106I, L106N, L106R, L106V, I117E, I117K, I117L, I117M, and/or I117T, or a conservative amino acid substitution thereof. In some embodiments, the ARBM is or contains a vIgD that has one or more amino acid modifications selected from 112F, L12P, I18T, A26T, G29W, T53S, M55T, M56K, M56T, N58S, S72G, M99L, L63P, L98Q, Y105L, L106I, and/or I117L, or a conservative amino acid substitution thereof. In some embodiments, the ARBM is or contains a vIgD has one or more amino acid modifications selected from L12P, I18T, A26T, G29W, A31Y, T53S, M55T, M56K, N58S, S72G, M99L, L63P, L98Q, Y105L, L106E, L106I, and/or I117L, or a conservative amino acid substitution thereof. In some embodiments, the ARBM is or contains a vIgD that has one or more amino acid modifications selected from A26T, G29W, L63P, S72G, L98Q, M99L, Y105L and/or L106I, or a conservative amino acid substitution thereof.

In some embodiments, the ARBM is or contains a vIgD that has two or more amino acid modifications selected from among A6T, V10A, L12F, L12H, L12I, L12P, S14N, S15P, R16C, R16G, R16H, I18A, I18F, I18N, I18T, I18V, A19V, S20N, V22A, V22I, E24Q, A26D, A26S, A26T, S27P, P28L, G29R, G29W, K30R, A31Y, E33M, E33V, R35K, T37S, V38I, Q41L, A42S, A42T, A42V, D43N, Q45H, V46E, T47A, E48R, T53S, Y54F, M55R, M55T, M55V, M56K, M56L, M56R, M56T, M56V, N58D, N58S, E59D, E59G, T61A, T61I, T61N, T61R, T61S, L63H, L63P, D64E, D64N, D64V, D65G, I67N, I67T, I67V, T69A, T69I, T69S, T71A, T71I, S72G, S72T, S73R, N75D, Q76R, Q82H, Q82R, R85G, A86T, M87A, M87K, M87T, M87V, T89A, T89M, T89S, L91R, I93L, I93V, K95R, V96I, E97Q, L98Q, L98R, M99I, M99L, Y105F, Y105L, L106E, L106I, L106N, L106R, L106V, I108F, I108V, N110K, N110S, N110Y, Q113H, Y115H, Y115N, V116A, I117E, I117K, I117L, I117M, I117T, P119H, E120D, P121S, C122P, D124P, D1241, S1251, S125P, D126P, and/or D126T.

In some embodiments, the ARBM is or contain a vIgD of CTLA-4 that has an amino acid substitution in an unmodified or wild-type CTLA-4 polypeptide or specific binding fragment thereof corresponding to A26T, G29W, T53S, L63P, S72G, L98Q, M99L, Y105L and/or L106I. In some embodiments, the ARBM is or contains a vIgD of CTLA-4 that contains the amino acid substitutions A26T/G29W, A26T/T53S, A26T/L63P, A26T/S72G, A26T/L98Q, A26T/M99L, A26T/Y105L, A26T/L106I, A26T/G29W, G29W/T53S, G29W/L63P, G29W/S72G, G29W/L98Q, G29W/M99L, G29W/Y105L, G29W/L106I, A26T/T53S, G29W/T53S, T53S/L63P, T53S/S72G, T53S/L98Q, T53S/M99L, T53S/Y105L, or T53S/L106I, A26T/L63P, G29W/L63P, T53S/L63P, L63P/S72G, L63P/L98Q, L63P/M99L, L63P/Y105L, or L63P/L106I, A26T/S72G, G29W/S72G, T53S/S72G, L63P/S72G, S72G/L98Q, S72G/M99L, S72G/Y105L or S72G/L106I, A26T/L98Q, G29W/L98Q, T53S/L98Q, L63P/L98Q, S72G/L98Q, L98Q/M99L, L98Q/Y105L or L98Q/L106I, A26T/M99L, G29W/M99L, T53S/M99L, L63P/M99L, S72G/M99L, L98Q/M99L, M99L/Y105L, M99L/L106I, A26T/Y105L, G29W/Y105L, T53S/Y105L, L63P/Y105L, S72G/Y105L, L98Q/Y105L, M99L/Y105L, Y105L/L106I, A26T/L106I, G29W/L106I, T53S/L106IL63P/L106I, S72G/L106I, L98Q/L106I, M99L/L106I, Y105L/L106I. The variant CTLA-4 polypeptide can include further amino acid modifications (e.g. substitutions), such as any described herein, in accord with provided embodiments.

In some embodiments, the amino acid modification(s), e.g. substitutions(s) are A31Y/L106E, A6T/A26T/M55T/M99L/Y105L, V10A/G29W/T53S/M56K/L63P/L98Q/Y105L/P121S, V10A/L63P/D64V/S72G/L98Q/M99L/Y105L, V10A/L63P/L98Q/Y105L, L12F/R16H/G29W/M56T/L98Q/Y105L, L12F/A26T/L63P/L98Q/Y105L/L106R, L12F/K30R/S72G/Q82R/L98Q/M99L/Y105L, L12H/I18V/A42T/M55T/N58D/L98R/Y105L/L106I/P121S, L12H/E33M/L98Q/Y105L, L12H/M55T/E59D/L63P/M99L, L12H/L63P/S72G/L98Q/Y105L, L12I/M55T/M56V/I67T/M99L/L106R/I108F, L12P/R16H/A26T/T61S/L63P/M87V/L98Q/M99L/Y105L/L106I/I117L, L12P/I18T/A26T/M55T/T69S/S72G/M99L/Y105L, L12P/A26T, L12P/A26T/L63P, L12P/A26T/L63P/S72G/T89M/L98Q/M99L/Y105L, L12P/G29W/L63P/S72G/L98Q/Y105L, L12P/G29W/L63P/S72G/L98Q/Y105L/L106I, L12P/A26T/L63P/L98Q/M99L/Y105L, L12P/A26T/L63P/L98Q/Y105L, L12P/A26T/L63P/L98Q/Y105L/L106I, L12P/G29W/D43N/N58S/L63P/L98Q/M99L/Y105L, L12P/M56V/L63P/V96I/L98Q/M99L/Y105L/Y115H, L12P/L63P/S72G/L98Q/M99L/Y105L, L12P/L63P/S72G/L98Q/M99L/Y105L/L106N, L12P/L63P/S72G/L98Q/M99L/

Y105L/L106N/I117L, S14N/R16C/I18T/M56K/T61A/L63P/A86T/M99L, S15P/I18V/M56T/L98Q/M99L/Y105L, R16C/G29W/E33V/M55T/L63P/L98Q/Y105L, I18A/L63P/S72G/L98Q/Y105L, I18F/L63P/L98Q/M99L/Y105L/P121S, I18N/A26T/L63H/T89A/L98Q/M99L/Y105L, I18N/L63P/S72T/M87T/L98Q/Y105L/N110S, I18T/A26S/M55T/M56V/L63P/S72G/L98Q/M99L/Y105L/I117K, I18T/A26T/L63P/S72G/L98Q/Y105L, I18T/A26T/L63P/Q82R/L98Q/Y105L, I18T/G29R/L63P/S72G/L98Q/M99L/Y105L, I18T/G29W/L63P/L98Q/Y105L, I18T/E48R/L63P/T69S/L98Q/Y105L/N110Y, I18T/T61R/L63P/S72G/L98Q/M99L/Y105L, I18T/L63P/S72G/M87K/L98Q/M99L/Y105L, I18T/L63P/S72G/L98Q/M99L/Y105L, I18T/L63P/S72G/L98Q/Y105L/I108V, I18V/A26T/L63P/D64E/L98Q/Y105L/L106R/N110K, I18V/G29W/L63P/S72G/L98Q/Y105L, A19V/G29W/R35K/L63P/L98Q/M99L/Y105L, S20N/A26T/L63P/L98Q/M99L/Y105L, V22A/L63P/L98Q/M99L/Y105L/P119H, V22I/L63P/L98Q/Y105L/I117M, E24Q/L63P/S72G/L98Q/M99L/Y105L, A26D/S72G/L98Q/M99L/Y105L, A26T/A42V/Q45H/I67N/M87K/E97Q/M99L, A26T/V46E/L63P/D65G/L98Q, A26T/T47A/M56K/L63P/S72G/Q82R/L98Q/M99L/Y105L, A26T/T53S/M56K/L63P/L98Q/Y105L, A26T/T53S/L63P/L98Q/Y105L/L106I/I117L, A26T/Y54F/M56K/M99L/Y105L, A26T/M55R/L98Q/M99L/Y105L, A26T/M55T/L63P/S72G/L98Q/M99L/Y105L, A26T/M55T/L63P/L98Q/M99L/Y105L, A26T/L63P/D65G/L98Q/M99L/Y105L, A26T/L63P/M87V/N110K/I117E, A26T/L63P/S72G/L98Q/M99L/Y105L, A26T/L63P/S72G/L98Q/Y105L/L106I/I117L, A26T/L63P/L98Q/M99L/Y105L, A26T/I67N/S72G/L98Q/M99L/Y105L, S27P/M56K/L63P/S72G/S73R/T89A/M99L/Y105L/I117M, P28L/E33V/L63P/S72G/L98Q/M99L/Y105L, P28L/E33V/L63P/S72G/L98R/M99L/Y105L, G29W/T53S/M56K/N58S/L63P/M87V/L98Q/Y105L, G29W/T53S/M56K/N58S/L63P/M87V/L98Q/Y105L/I108V, G29W/T53S/M56K/N58S/L63P/M87V/L98Q/Y105L/P121S, G29W/T53S/M56K/T61N/L63P/L98Q/Y105L, G29W/T53S/M56K/L63P/Q82H/L98Q/M99I/Y105L, G29W/T53S/M56K/L63P/L98Q/Y105L, G29W/T53S/L63P/S72G/L98Q/Y105L, G29W/M55V/E59G/L63P/L98Q/Y105L, G29W/M56T/L63P/L98Q/Y105L/L106I/I117L, G29W/N58D/I67V/L98Q/M99L/Y105L, G29W/N58S/L63P/D64N/L98Q/M99L/Y105L, G29W/N58S/L63P/T69I/L98Q/M99L/Y105L, G29W/N58S/L63P/S72G/L98Q/Y105L, G29W/N58S/L63P/S72G/L98Q/Y105L/L106I, G29W/N58S/L63P/S72G/L98Q/Y105L/L106V, G29W/N58S/L63P/S72G/M87V/L98Q/Y105L, G29W/N58S/L63P/Q82R/L98Q/Y105L, G29W/N58S/L63P/M87T/L98Q/M99L/Y105L, G29W/N58S/L63P/L98Q/Y105L, G29W/E59G/L63P/L98Q/Y105L, G29W/T61I/L63P/S72G/L98Q/M99L/Y105L, G29W/L63P/D65G/S72G/L98Q/Y105L, G29W/L63P/I67V/S72G/L98Q/Y105L, G29W/L63P/S72G/L98Q/Y105L/L106I, G29W/L63P/S72G/L98Q/Y105L/L106I/I117L, G29W/L63P/S72G/L98Q/Y105L/I117L, G29W/L63P/S72G/L98Q/Y105L/P121S, G29W/L63P/L98Q/M99L/Y105L, G29W/S72G/Q76R/L98Q/Y105L/L106I/Q113H, G29W/M87K/T89S/L98Q/M99L/Y105L/I108V/I117L, G29W/M87K/I93V/L98Q/M99L/Y105L, G29W/L98Q/M99L/Y105L, E33M/A42T/L98Q/Y105L, E33M/L63P/S72G/L98Q/Y105L, E33M/L63P/S72G/L98Q/Y105L/I108F, E33M/L63P/S72G/L98Q/Y105L/I117L, E33M/Q82H/L98Q/M99L/Y105L, E33V/A42S/M55T/L98Q/M99L/Y105L, T37S/M56V/L98Q/Y105L, V38I/L63P/S72G/L98Q/M99L/Y105L, Q41L/Y54F/M56K/M99L/I108F, T53S/M56V/L98Q/Y105L, M55T/L63P/T71I/M99L/Y105L, M55T/S72G/L98Q/M99L/Y105L, M55T/E97Q/M99L/Y105F, M56K/L63P/N75D/V96I/M99L/Y105L/L106I, M56L/L63P/L98Q/Y105L/L106I/I117L, M56R/L63P/L98Q/M99L/Y105L, M56T/L91R/L98Q/Y105L, M56V/E59G/L63P/S72G/M87K/I93V/L98Q/M99L/Y105L/I117E, T61A/L63P/S72G/L98Q/M99L/Y105L, L63P/T69A/L98Q/M99L/Y105L/L106R/V116A, L63P/S72G/M87A/L98Q/Y105L, L63P/S72G/I93L/L98Q/M99L/Y105L, L63P/S72G/L98Q/M99L/Y105L, L63P/S72G/L98Q/M99L/Y105L/L106I/I117L, L63P/S72G/L98Q/Y105L, L63P/S72G/L98Q/Y105L/L106I/I117L, L63P/S72G/Y105L, L63P/M87K/M99L/L106R, L63P/Q82H/L98Q/M99L/Y105L, L63P/K95R, L63P/L98Q, L63P/L98Q/M99L/Y105L, L63P/L98Q/M99L/Y105L/L106I, L63P/L98Q/M99L/Y105L/I108V, L63P/L98Q/M99L/Y105L/I117M, L63P/L98Q/Y105L, L63P/L98Q/V116A, L63P/L98R/N110K, L63P/M99L/Y105L/I108F, I67V/S72G/Q82H/T89A/L98Q/M99L/Y105L, 872G/R85G/L98Q/M99L/Y105L/L106I, S72G/L98Q/M99L/Y105L/I117T, L98Q/M99L/Y105L, L98Q/M99L/Y105L/L106I/I117T, L98Q/M99L/Y105L/L106I/Y115N, L98Q/Y105L, and L98R/N110K.

In some embodiments, the ARBM is or contains a vIgD of CTLA-4 that additionally includes the amino acid modifications C122S with reference to positions set forth in SEQ ID NO:36 or 2655.

In some embodiments, the ARBM is or contains an IgD (e.g. IgV) of wild-type CTLA-4 set forth in Table 10 or a vIgD thereof comprising any of the modifications (e.g. substitutions) listed in Table 10. Table 10 also provides exemplary sequences by reference to SEQ ID NO for the extracellular domain (ECD) or IgV domain of CTLA-4. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of an ARBM, such as to ensure proper folding of the domain when expressed. Thus, it is understood that the exemplification of the SEQ ID NOS in Table 10 is not to be construed as limiting. For example, the particular domain, such as the IgV domain, of a variant CTLA-4 polypeptide can be several amino acids longer or shorter, such as 1-10, e.g. 1, 2, 3, 4, 5, 6 or 7 amino acids longer or shorter, than the sequence of amino acids set forth in the respective SEQ ID NO.

In some embodiments, the ARBM is or contains a wild-type CTLA-4 ECD set forth in SEQ ID NO: 36 or SEQ ID NO:2655 or a variant CTLA-4 ECD set forth in any one of SEQ ID NOS: 2519, 2520, 2948-3041, 3043-3048, 3050-3099, 3230, 3231, 3582-3614 or 3648. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any one of SEQ ID NOS: 2519, 2520, 2948-3041, 3043-3048, 3050-3099, 3230, 3231, 3582-3614 or 3684 and contains the amino acid modification(s), e.g. substitution(s) not present in the wild-type or unmodified CTLA-4, e.g. not present in SEQ ID NO:36 or 2655. In some embodiments, the ARBM is or contains a specific binding fragment of any of the ECD sequences set forth in any one of SEQ ID NOS: 2519, 2520, 2948-3041, 3043-3048, 3050-3099, 3230, 3231, 3582-3614 or 3648 and that contains the amino acid modification(s), e.g. substitution(s) not present in the wild-type or unmodified CTLA-4, e.g. not present in SEQ ID NO:36 or 2655.

In some embodiments, the ARBM is or contains a wild-type CTLA-4 IgV set forth in SEQ ID NO: 2947 or a variant IgV sequence set forth in any one of SEQ ID NOS: 3100-3229, 3232, 3615-3647 or 3649. In some embodiments, the ARBM is or contains a sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in any one of SEQ ID NOS: 3100-3229, 3232, 3615-3647 or 3649 and contains the amino acid modification(s), e.g., substitution(s), not present in the wild-type or unmodified CTLA-4, e.g. not present in SEQ ID NO:2947. In some embodiments, the ARBM is a specific binding fragment of any of the IgV sequences set forth in any one of SEQ ID NOS: 3100-3229, 3232, 3615-3647 or 3649 and that contains the amino acid modification(s), e.g. substitution(s) not present in the wild-type or unmodified CTLA-4, e.g. set forth in SEQ ID NO:2947.

TABLE 10

Exemplary variant CTLA-4 ARBMs containing an IgD or vIgD

| Mutation(s) | ECD SEQ ID NO | IgV SEQ ID NO |
|---|---|---|
| Wild-type | 36, 2655 | 2947 |
| L12P/A26T/L63P/L98Q/Y105L | 2948 | 3100 |
| L63P/L98R/N110K | 2949 | 3101 |
| L12P/A26T | 2950 | 3102 |
| L12P/A26T/L63P | 2951 | 3103 |
| L63P/L98Q/Y105L | 2952 | 3104 |
| L98Q/Y105L | 2953 | 3105 |
| L63P | 2954 | 3106 |
| L98R/N110K | 2955 | 3107 |
| L12P/A26T/L63P/L98Q/M99L/Y105L | 2956 | 3108 |
| E33M/Q82H/L98Q/M99L/Y105L | 2957 | 3109 |
| L63P/S72G/L98Q/M99L/Y105L | 2958 | 3110 |
| S14N/R16C/I18T/M56K/T61A/L63P/A86T/M99L | 2959 | 3111 |
| S27P/M56K/L63P/S72G/S73R/T89A/M99L/Y105L/I117M | 2960 | 3112 |
| M56K/L63P/N75D/V96I/M99L/Y105L/L1061 | 2961 | 3113 |
| L63P/S72G/Y105L | 2962 | 3114 |
| L63P/L98Q/M99L/Y105L/I117M | 2963 | 3171 |
| L63P/S72G/L98Q/M99L/Y105L/L1061/I117L | 2964 | 3110 |
| A26T/L63P/S72G/L98Q/Y105L/L1061/I117L | 2965 | 3115 |
| L63P/L98Q/V116A | 2966 | 3149 |
| G29W/L98Q/M99L/Y105L | 2967 | 3116 |
| T37S/M56V/L98Q/Y105L | 2968 | 3117 |
| A26T/Y54F/M56K/M99L/Y105L | 2969 | 3118 |
| L12P/I18T/A26T/M55T/T69S/S72G/M99L/Y105L | 2970 | 3119 |
| V22I/L63P/L98Q/Y105L/I117M | 2971 | 3120 |
| A26T/L63P/S72G/L98Q/M99L/Y105L | 2972 | 3121 |
| E33M/A42T/L98Q/Y105L | 2973 | 3122 |
| M55T/E97Q/M99L/Y105F | 2974 | 3123 |
| M55T/S72G/L98Q/M99L/Y105L | 2975 | 3124 |
| R16C/G29W/E33V/M55T/L63P/L98Q/Y105L | 2976 | 3125 |
| L12P/A26T/L63P/L98Q/Y105L/L1061 | 2977 | 3100 |
| M56L/L63P/L98Q/Y105L/L1061/I117L | 2978 | 3126 |
| S15P/I18V/M56T/L98Q/M99L/Y105L | 2979 | 3127 |
| I18T/G29W/L63P/L98Q/Y105L | 2980 | 3128 |
| L63P/Q82H/L98Q/M99L/Y105L | 2981 | 3129 |
| L98Q/M99L/Y105L/L106I/I117T | 2982 | 3150 |
| L98Q/M99L/Y105L/L1061/Y115N | 2983 | 3150 |
| M55T/L63P/T711/M99L/Y105L | 2984 | 3130 |
| A26T/T53S/M56K/L63P/L98Q/Y105L | 2985 | 3131 |
| I18T/A26T/L63P/Q82R/L98Q/Y105L | 2986 | 3132 |
| L12H/M55T/E59D/L63P/M99L | 2987 | 3133 |
| I18T/L63P/S72G/L98Q/Y105L/I108V | 2988 | 3134 |
| I18T/L63P/S72G/L98Q/M99L/Y105L | 2989 | 3135 |
| T61A/L63P/S72G/L98Q/M99L/Y105L | 2990 | 3136 |
| V381/L63P/S72G/L98Q/M99L/Y105L | 2991 | 3137 |
| L63P/S72G/I93L/L98Q/M99L/Y105L | 2992 | 3138 |
| L12I/M55T/M56V/I67T/M99L/L106R/I108F | 2993 | 3139 |
| I18N/A26T/L63H/T89A/L98Q/M99L/Y105L | 2994 | 3140 |
| I18T/E48R/L63P/T69S/L98Q/Y105L/N110Y | 2995 | 3141 |
| I18N/L63P/S72T/M87T/L98Q/Y105L/N110S | 2996 | 3142 |
| G29W/M56T/L63P/L98Q/Y105L/L1061/I117L | 2997 | 3143 |
| G29W/N58S/L63P/M87T/L98Q/M99L/Y105L | 2998 | 3144 |
| G29W/N58S/L63P/D64N/L98Q/M99L/Y105L | 2999 | 3145 |
| I18T/L63P/S72G/M87K/L98Q/M99L/Y105L | 3000 | 3146 |
| M56V | 3001 | 3147 |
| L63P/K95R | 3002 | 3148 |
| L63P/L98Q | 3003 | 3149 |
| L98Q/M99L/Y105L | 3004 | 3150 |
| L63P/M87K/M99L/L106R | 3005 | 3151 |
| L63P/M99L/Y105L/I108F | 3006 | 3152 |
| V10A/L63P/L98Q/Y105L | 3007 | 3153 |

TABLE 10-continued

Exemplary variant CTLA-4 ARBMs containing an IgD or vIgD

| Mutation(s) | ECD SEQ ID NO | IgV SEQ ID NO |
|---|---|---|
| M56T/L91R/L98Q/Y105L | 3008 | 3154 |
| A26T/L63P/M87V/N110K/I117E | 3009 | 3155 |
| G29W/L63P/L98Q/M99L/Y105L | 3010 | 3156 |
| A26T/V46E/L63P/D65G/L98Q | 3011 | 3157 |
| G29W/N58S/L63P/L98Q/Y105L | 3012 | 3158 |
| G29W/E59G/L63P/L98Q/Y105L | 3013 | 3159 |
| LI2H/L63P/S72G/L98Q/Y105L | 3014 | 3160 |
| A6T/A26T/M55T/M99L/Y105L | 3015 | 3161 |
| A26T/L63P/D65G/L98Q/M99L/Y105L | 3016 | 3162 |
| V10A/L63P/D64V/S72G/L98Q/M99L/Y105L | 3017 | 3163 |
| LI2P/G29W/D43N/N58S/L63P/L98Q/M99L/Y105L | 3018 | 3164 |
| I18V/A26T/L63P/D64E/L98Q/Y105L/L106R/N110K | 3019 | 3165 |
| A19V/G29W/R35K/L63P/L98Q/M99L/Y105L | 3020 | 3166 |
| L12P/A26T/L63P/S72G/T89M/L98Q/M99L/Y105L | 3021 | 3167 |
| P28L/E33V/L63P/S72G/L98R/M99L/Y105L | 3022 | 3168 |
| E24Q/L63P/S72G/L98Q/M99L/Y105L | 3023 | 3169 |
| I18T/G29R/L63P/S72G/L98Q/M99L/Y105L | 3024 | 3170 |
| L63P/L98Q/M99L/Y105L | 3025 | 3171 |
| Q41L/Y54F/M56K/M99L/I108F | 3026 | 3172 |
| S72G/L98Q/M99L/Y105L/I117T | 3027 | 3173 |
| M56R/L63P/L98Q/M99L/Y105L | 3028 | 3174 |
| E33M/L63P/S72G/L98Q/Y105L | 3029 | 3175 |
| L63P/L98Q/M99L/Y105L/L1061 | 3030 | 3171 |
| A26T/M55R/L98Q/M99L/Y105L | 3031 | 3176 |
| L63P/S72G/M87A/L98Q/Y105L | 3032 | 3177 |
| A26D/S72G/L98Q/M99L/Y105L | 3033 | 3178 |
| V22A/L63P/L98Q/M99L/Y105L/P119H | 3034 | 3179 |
| A26T/M55T/L63P/L98Q/M99L/Y105L | 3035 | 3180 |
| E33V/A42S/M55T/L98Q/M99L/Y105L | 3036 | 3181 |
| G29W/N58S/L63P/Q82R/L98Q/Y105L | 3037 | 3182 |
| E33M/L63P/S72G/L98Q/Y105L/I117L | 3038 | 3175 |
| A26T/I67N/S72G/L98Q/M99L/Y105L | 3039 | 3183 |
| L12F/A26T/L63P/L98Q/Y105L/L106R | 3040 | 3184 |
| S20N/A26T/L63P/L98Q/M99L/Y105L | 3041 | 3185 |
| G29W/T611/L63P/S72G/L98Q/M99L/Y105L | 3043 | 3186 |
| G29W/N58S/L63P/T69I/L98Q/M99L/Y105L | 3044 | 3187 |
| L12P/L63P/S72G/L98Q/M99L/Y105L/L106N | 3045 | 3188 |
| L63P/T69A/L98Q/M99L/Y105L/L106R/V116A | 3046 | 3189 |
| G29W/N58S/L63P/S72G/L98Q/Y105L | 3047 | 3190 |
| G29W/L63P/D65G/S72G/L98Q/Y105L | 3048 | 3191 |
| T53S/M56V/L98Q/Y105L | 3050 | 3193 |
| L63P/S72G/L98Q/Y105L | 3051 | 3194 |
| I18A/L63P/S72G/L98Q/Y105L | 3052 | 3195 |
| G29W/T53S/M56K/L63P/L98Q/Y105L | 3053 | 3196 |
| I18V/G29W/L63P/S72G/L98Q/Y105L | 3054 | 3197 |
| G29W/L63P/S72G/L98Q/Y105L/L106I | 3055 | 3198 |
| G29W/L63P/I67V/S72G/L98Q/Y105L | 3056 | 3199 |
| G29W/M55V/E59G/L63P/L98Q/Y105L | 3057 | 3200 |
| G29W/L63P/S72G/L98Q/Y105L/I117L | 3058 | 3198 |
| L63P/S72G/L98Q/Y105L/L106I/I117L | 3059 | 3194 |
| L12F/R16H/G29W/M56T/L98Q/Y105L | 3060 | 3201 |
| LI2P/G29W/L63P/S72G/L98Q/Y105L | 3061 | 3202 |
| L12P/G29W/L63P/S72G/L98Q/Y105L/L1061 | 3062 | 3202 |
| G29W/L63P/S72G/L98Q/Y105L/L1061/I117L | 3063 | 3198 |
| G29W/N58S/L63P/S72G/L98Q/Y105L/L106I | 3064 | 3191 |
| A26T/T53S/L63P/L98Q/Y105L/L1061/I117L | 3065 | 3203 |
| G29W/N58S/L63P/S72G/M87V/L98Q/Y105L | 3066 | 3204 |
| G29W/S72G/Q76R/L98Q/Y105L/L1061/Q113H | 3067 | 3205 |
| G29W/N58S/L63P/S72G/L98Q/Y105L/L106V | 3068 | 3191 |
| A26T/L63P/L98Q/M99L/Y105L | 3069 | 3206 |
| G29W/N58D/I67V/L98Q/M99L/Y105L | 3070 | 3207 |
| I67V/S72G/Q82H/T89A/L98Q/M99L/Y105L | 3071 | 3208 |
| S72G/R85G/L98Q/M99L/Y105L/L106I | 3072 | 3209 |
| A26T/T47A/M56K/L63P/S72G/Q82R/L98Q/M99L/Y105L | 3073 | 3210 |
| A26T/M55T/L63P/S72G/L98Q/M99L/Y105L | 3074 | 3211 |
| L12H/I18V/A42T/M55T/N58D/L98R/Y105L/L1061/P121S | 3075 | 3212 |
| I18T/A26T/L63P/S72G/L98Q/Y105L | 3076 | 3213 |
| L12F/K30R/S72G/Q82R/L98Q/M99L/Y105L | 3077 | 3214 |
| L12P/L63P/S72G/L98Q/M99L/Y105L/L106N/I117L | 3078 | 3225 |
| G29W/M87K/I93V/L98Q/M99L/Y105L | 3079 | 3215 |
| P28L/E33V/L63P/S72G/L98Q/M99L/Y105L | 3080 | 3216 |
| G29W/T53S/M56K/L63P/Q82H/L98Q/M99I/Y105L | 3081 | 3217 |
| I18F/L63P/L98Q/M99L/Y105L/P121S | 3082 | 3218 |
| L63P/L98Q/M99L/Y105L/I108V | 3083 | 3171 |

TABLE 10-continued

| Exemplary variant CTLA-4 ARBMs containing an IgD or vIgD | | |
|---|---|---|
| Mutation(s) | ECD SEQ ID NO | IgV SEQ ID NO |
| A26T/A42V/Q45H/I67N/M87K/E97Q/M99L | 3084 | 3219 |
| M56V/E59G/L63P/S72G/M87K/I93V/L98Q/M99L/Y105L/I117E | 3085 | 3220 |
| G29W/M87K/T89S/L98Q/M99L/Y105L/I108V/I117L | 3086 | 3186 |
| L12P/M56V/L63P/V961/L98Q/M99L/Y105L/Y115H | 3087 | 3221 |
| G29W/T53S/M56K/T61N/L63P/L98Q/Y105L | 3088 | 3222 |
| I18T/A26S/M55T/M56V/L63P/S72G/L98Q/M99L/Y105L/I117K | 3089 | 3223 |
| I18T/T61R/L63P/S72G/L98Q/M99L/Y105L | 3090 | 3224 |
| LI2P/L63P/S72G/L98Q/M99L/Y105L | 3091 | 3225 |
| E33M/L63P/S72G/L98Q/Y105L/I108F | 3092 | 3175 |
| L12P/R16H/A26T/T61S/L63P/M87V/L98Q/M99L/Y105L/L1061/I117L | 3093 | 3226 |
| G29W/T53S/M56K/N58S/L63P/M87V/L98Q/Y105L/P121S | 3094 | 3227 |
| G29W/L63P/S72G/L98Q/Y105L/P121S | 3095 | 3198 |
| G29W/T53S/M56K/N58S/L63P/M87V/L98Q/Y105L | 3096 | 3227 |
| G29W/T53S/M56K/N58S/L63P/M87V/L98Q/Y105L/I108V | 3097 | 3227 |
| G29W/T53S/L63P/S72G/L98Q/Y105L | 3098 | 3228 |
| V10A/G29W/T53S/M56K/L63P/L98Q/Y105L/P121S | 3099 | 3229 |
| A31Y/L106E | 2519, 3230 | 3232 |
| A31Y/L106E/C122S | 2520, 3231 | 3232 |
| T89A/L98Q/M99L/Y105L/L106I/Y115N/E120D/C122P/D124P/S1251/D126P | 3582 | 3615 |
| N58S/L63P/T71A/S72G/L98Q/M99L/Y105L/D1241/S125P/D126T | 3583 | 3616 |
| R16G/E33M/N58S/E59G/L63P/L98Q/Y105L/E120D/C122P/D124P/S1251/D126P | 3584 | 3617 |
| G29W/L63P/S72G/L98Q/Y105L/P121S/D126T | 3585 | 3618 |
| L12H/E33M/L98Q/Y105L | 3586 | 3619 |
| T53S/M56K/N58S/L63P/M87V/L98Q/Y105L | 3587 | 3620 |
| I18T/A26T/M55T/M56K/L63P/L98Q/M99L/Y105L | 3588 | 3621 |
| I18T/A26T/M56K/L63P/L98Q/Y105L | 3589 | 3622 |
| T53S/L63P/L98Q | 3590 | 3623 |
| T53S/L63P/Y105L | 3591 | 3624 |
| T53S/M56K/N58S/L63P/M87V/L98Q | 3592 | 3625 |
| T53S/M56K/N58S/L63P/M87V/Y105L | 3593 | 3626 |
| T53S/M56K/N58S/L63P/L98Q/Y105L | 3594 | 3627 |
| T53S/M56K/N58S/M87V/L98Q/Y105L | 3595 | 3628 |
| T53S/M56K/L63P/M87V/L98Q/Y105L | 3596 | 3629 |
| T53S/N58S/L63P/M87V/L98Q/Y105L | 3597 | 3630 |
| M56K/N58S/L63P/M87V/L98Q/Y105L | 3598 | 3631 |
| E33V/L98Q/Y105L | 3599 | 3632 |
| E33V/M99L/Y105L | 3600 | 3633 |
| E33V/L98Q/M99L | 3601 | 3634 |
| E33V/M99L | 3602 | 3635 |
| L12F/R16H/G29W/M56T/L98Q | 3603 | 3636 |
| L12F/R16H/G29W/M56T/Y105L | 3604 | 3637 |
| L12F/R16H/G29W/L98Q/Y105L | 3605 | 3638 |
| L12F/R16H/M56T/L98Q/Y105L | 3606 | 3639 |
| G29W/M567/L98Q/Y105L | 3607 | 3640 |
| L12F/G29W/L98Q/Y105L | 3608 | 3641 |
| LI2F/L98Q/Y105L | 3609 | 3642 |
| R16H/L98Q/Y105L | 3610 | 3643 |
| G29W/L98Q/Y105L | 3611 | 3644 |
| M56T/L98Q/Y105L | 3612 | 3645 |
| L12F/R16H/G29W/M56T/S72G/L98Q/Y105L | 3613 | 3646 |
| G29W/M56T/S72G/L98Q/Y105L | 3614 | 3647 |
| I18T/T61R/L63P/S72G/L98Q/M99L/P102L/Y105L | 3648 | 3649 |

b. MHC Binding Molecules

Provided herein are immunomodulatory proteins containing an ARBM that is or contains a binding molecule that binds an major histocompatibility complex (MHC), e.g. MHC class I or MHC class II. In some embodiments, the MHC is human, e.g. human MHC class I or human MHC class II. In some embodiments, the ARBM binds to an MCH on the surface of a cell, such as on the surface of an APC.

In some embodiments, the provided immunomodulatory proteins contain an ARBM is or contains an antibody that binds an MHC or is an antigen-binding fragment thereof (e.g. Fab or scFv). In some embodiments, the antibody or antigen-binding antibody fragment thereof binds human MHC, such as human MHC class I and/or human MHC class II. In some embodiments, the antibody is a pan-MHC antibody. In some embodiments, the antibody is a single chain variable fragment (e.g. scFv) containing a VH and VL of an anti-MHC antibody or antigen-binding fragment, such as is a pan-MHC scFv antibody.

In some embodiments, the ARBM is or contains one or more IgD(s) or a specific binding fragment thereof, such as an unmodified or wild-type IgD or a vIgD or a specific binding fragment thereof, of an IgSF family member that bind an MHC, such as an MHC class I or an MHC class II. In some embodiments, the MHC is human MHC, such as a human MHC class I or human MHC class II. In some embodiments, the ARBM is or contains one or more IgD that is an IgD, or a vIgD thereof, of a TCR, CD4, CD8, or LAG3 polypeptide, such as a wild-type TCR, CD4, CD8 or LAG3, e.g. a human TCR, a human CD4, human CD8 or human LAG3. In some embodiments, the ARBM is not the full length sequence of the TCR, CD4, CD8 or LAG3. In some aspects, the ARBM is a soluble polypeptide, is not membrane-expressed and/or lacks the transmembrane and/or cytoplasmic domain of a TCR, CD4, CD8 or LAG3. In some embodiments, the ARBM only contains an extracellular domain (ECD) or a specific binding fragment thereof containing a IgD or vIgD, such as only contains an IgV domain or an IgC domain or specific binding fragment thereof, or combinations thereof.

In some embodiments, the ARBM is or contains an IgD of a wild-type or unmodified CD4 or a vIgD thereof. In some embodiments, the ARBM is or contains the ECD sequence set forth in SEQ ID NO:40 or is a specific binding fragment thereof. In some embodiments, the ARBM is or contains an IgD sequence of CD4, such as humanCD4. In some embodiments, the ARBM is or contain an IgD sequence set forth in SEQ ID NO:3490, or is a specific binding fragment thereof.

```
                                   (SEQ ID NO: 40)
KKVVLGKKGDTVELTCTASQKKSIQFHWKNSNQIKI

LGNQGSFLTKGPSKLNDRADSRRSLWDQGNFPLIIK

NLKIEDSDTYICEVEDQKEEVQLLVFGLTANSDTHL

LQGQSLTLTLESPPGSSPSVQCRSPRGKNIQGGKTL

SVSQLELQDSGTWTCTVLQNQKKVEFKIDIVVLAFQ

KASSIVYKKEGEQVEFSFPLAFTVEKLTGSGELWWQ

AERASSSKSWITFDLKNKEVSVKRVTQDPKLQMGKK

LPLHLTLPQALPQYAGSGNLTLALEAKTGKLHQEVN

LVVMRATQLQKNLTCEVWGPTSPKLMLSLKLENKEA

KVSKREKAVWVLNPEAGMWQCLLSDSGQVLLESNIK

VLPTWSTPVQP

                                 (SEQ ID NO: 3490)
KKVVLGKKGDTVELTCTASQKKSIQFHWKNSNQIKIL

GNQGSFLTKGPSKLNDRADSRRSLWDQGNFPLIIKNL

KIEDSDTYICEVEDQKEEVQLLVFGL
```

In some aspects, the ARBM contains one or more IgD that is an vIgD containing one or more amino acid modifications (e.g., substitutions, deletions or additions) compared to an IgD of a wild-type or unmodified CD4, which, in some aspects, result in increased binding of the ARBM to an MHC molecule. In some embodiments, modifications provided herein can be in an ARBM containing an unmodified IgD set forth in SEQ ID NO:40 or 3490 or in a sequence that has 85%, 85%, 87%, 88%, 89%, 90%, 91%, 92%, 93%, 94%, 95%, 96%, 97%, 98%, 99% or more sequence identity to SEQ ID NO: 40 or 3490. In some embodiments, an ARBM containing a vIgD of CD4 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 40 or 3490.

In some embodiments, the ARBM is or contains an IgD of a wild-type or unmodified CD8, such as a CD8alpha (CD8a) and/or CD8beta (CD8b), or a vIgD thereof. In some embodiments, the ARBM is or contains the ECD sequence set forth in SEQ ID NO:41 or 42 or is a specific binding fragment thereof. In some embodiments, the ARBM is or contains an IgD sequence of CD8a or CD8b, such as human CD8a or CD8b. In some embodiments, the ARBM is or contain an IgD sequence set forth in SEQ ID NO:3491 or 3233, or is a specific binding fragment thereof.

```
CD8-alpha
                                   (SEQ ID NO: 41)
SQFRVSPLDRTWNLGETVELKCQVLLSNPTSGCSWL

FQPRGAAASPTFLLYLSQNKPKAAEGLDTQRFSGKR

LGDTFVLTLSDFRRENEGYYFCSALSNSIMYFSHFV

PVFLPAKPTTTPAPRPPTPAPTIASQPLSLRPEACR

PAAGGAVHTRGLDFACD

CD8-beta
                                   (SEQ ID NO: 42)
LQQTPAYIKVQTNKMVMLSCEAKISLSNMRIYWLRQ

RQAPSSDSHHEFLALWDSAKGTIHGEEVEQEKIAVF

RDASRFILNLTSVKPEDSGIYFCMIVGSPELTFGKG

TQLSVVDFLPTTAQPTKKSTLKKRVCRLPRPETQKG

PLCSP

CD8-alpha
                                 (SEQ ID NO: 3491)
SQFRVSPLDRTWNLGETVELKCQVLLSNPTSGCSWL

FQPRGAAASPTFLLYLSQNKPKAAEGLDTQRFSGKR

LGDTFVLTLSDFRRENEGYYFCSALSNSIMYFSHFV

PVFLPA

CD8-beta
                                 (SEQ ID NO: 3233)
LQQTPAYIKVQTNKMVMLSCEAKISLSNMRIYWLRQ

RQAPSSDSHHEFLALWDSAKGTIHGEEVEQEKIAVF

RDASRFILNLTSVKPEDSGIYFCMIVGSPELTFGKG

TQL
```

In some aspects, the ARBM contains one or more IgD that is an vIgD containing one or more amino acid modifications (e.g., substitutions, deletions or additions) compared to an IgD of a wild-type or unmodified CD4, which, in some aspects, result in increased binding of the ARBM to an MHC molecule. In some embodiments, modifications provided herein can be in an ARBM containing an unmodified IgD set forth in SEQ ID NO:41, 32, 3491 or 3233 or in a sequence that has 85%, 85%, 87%, 88%, 89%, 90%, 91%, 92%, 93%, 94%, 95%, 96%, 97%, 98%, 99% or more sequence identity to SEQ ID NO: 41, 32, 3491 or 3233. In some embodiments, an ARBM containing a vIgD of CD8 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 41, 32, 3491 or 3233.

In some embodiments, the ARBM is or contains an IgD of a wild-type or unmodified LAG3 or a vIgD thereof. In some embodiments, the ARBM is or contains the ECD sequence set forth in SEQ ID NO:43 or is a specific binding fragment thereof. In some embodiments, the ARBM is or contains an IgD sequence of LAG3, such as human LAG3. In some embodiments, the ARBM is or contain an IgD sequence set forth in SEQ ID NO:3492, or is a specific binding fragment thereof.

(SEQ ID NO: 43)
VPVVWAQEGAPAQLPCSPTIPLQDLSLLRRAGVTWQ

HQPDSGPPAAAPGHPLAPGPHPAAPSSWGPRPRRYT

VLSVGPGGLRSGRLPLQPRVQLDERGRQRGDFSLWL

RPARRADAGEYRAAVHLRDRALSCRLRLRLGQASMT

ASPPGSLRASDWVILNCSFSRPDRPASVHWFRNRGQ

GRVPVRESPHHHLAESFLFLPQVSPMDSGPWGCILT

YRDGFNVSIMYNLTVLGLEPPTPLTVYAGAGSRVGL

PCRLPAGVGTRSFLTAKWTPPGGGPDLLVTGDNGDF

TLRLEDVSQAQAGTYTCHIHLQEQQLNATVTLAIIT

VTPKSFGSPGSLGKLLCEVTPVSGQERFVWSSLDTP

SQRSFSGPWLEAQEAQLLSQPWQCQLYQGERLLGAA

VYFTELSSPGAQRSGRAPGALPAGHLLLFLILGVLS

LLLLVTGAFGFHLWRRQWRPRRFSALEQGIHPPQAQ

SKIEELEQEPEPEPEPEPEPEPEPEPEQL (SEQ ID NO: 3492)
GAPAQLPCSPTIPLQDLSLLRRAGVTWQHQPDSGPP

AAAPGHPLAPGPHPAAPSSWGPRPRRYTVLSVGPGG

LRSGRLPLQPRVQLDERGRQRGDFSLWLRPARRADA

GEYRAAVHLRDRALSCRLRLRLG

In some aspects, the ARBM contains one or more IgD that is an vIgD containing one or more amino acid modifications (e.g., substitutions, deletions or additions) compared to an IgD of a wild-type or unmodified LAG3, which, in some aspects, result in increased binding of the ARBM to an MHC molecule. In some embodiments, modifications provided herein can be in an ARBM containing an unmodified IgD set forth in SEQ ID NO:43 or 3492 or in a sequence that has 85%, 85%, 87%, 88%, 89%, 90%, 91%, 92%, 93%, 94%, 95%, 96%, 97%, 98%, 99% or more sequence identity to SEQ ID NO: 43 or 3492. In some embodiments, an ARBM containing a vIgD of LAG3 has at least about 85%, 86%, 86%, 88%, 89%, 90%, 91%, 92%, 93%, 94%, 95%, 96%, 97%, 98%, or 99% sequence identity with the sequence set forth in any of SEQ ID NOs: 43 or 3492.

II. SINGLE-DOMAIN IMMUNOMODULATORY PROTEINS

Provided herein are single-domain immunomodulatory proteins that contain one or more inhibitory receptor binding molecule (IRBM) that binds to an inhibitory receptor or one or more activating receptor binding molecule (ARBM) that binds to an activating receptor or a ligand of an activating receptor. In some embodiments, the IRBM can be any binding molecule that binds to an inhibitory receptor, such as those described in Section I. A. In some embodiments, the ARBM can be any binding molecule that binds to an activating receptor or a ligand thereof, such as any described in Section I. B. In some embodiments, the single-domain immunomodulatory protein contains one or more IRBM or ARBM that includes an antibody or an antigen-binding antibody fragment. In some aspects, the single-domain immunomodulatory protein contains an IRBM or ARBM that is a human antibody and/or an antibody that binds a human protein.

In some embodiments, the single-domain immunomodulatory protein contains an IRBM or ARBM that is not an antibody or antigen-binding fragment. In some embodiments, the IRBM or ARBM is or contains a non-antibody immunoglobulin superfamily (IgSF) domain (IgD) of an IgSF member, or is a specific binding fragment of such an IgSF domain. In some embodiments, the at least one of the IRBM or ARBM can be a variant IgD in which is contained one or more amino acid modifications (e.g. substitutions) in an IgD, such as any of the exemplary variant IgD provided in Section I.

In some embodiments, the ARBM can bind to an activating receptor with at least a certain binding activity as described in Section I, such as binding affinity, as measured by any of a number of known methods. In some embodiments, the IRBM can bind to an inhibitory receptor with at least a certain binding activity as described in Section I, such as binding affinity, as measured by any of a number of known methods.

In some embodiments, the single-domain immunomodulatory proteins provided herein are soluble proteins and/or do not contain a portion that includes a transmembrane domain. Those of skill will appreciate that cell surface proteins, including proteins of the IgSF, typically have an intracellular domain, a transmembrane domain, and extracellular domain (ECD), and that a soluble form of such proteins can be made using the extracellular domain or an immunologically active subsequence thereof. Thus, in some embodiments, the ARBM or IRBM lacks a transmembrane domain or a portion of the transmembrane domain of an IgSF member. In some embodiments, the ARBM or IRBM lacks the intracellular (cytoplasmic) domain or a portion of the intracellular domain of an IgSF member. In some embodiments, the ARBM or IRBM only contains the ECD domain or a portion thereof containing an IgSF domain, such an IgV domain, or specific binding fragments thereof. In some cases, the ARBM and IRBM independently can include the extracellular domain of an IgSF family member or an IgSF domain or specific binding fragment thereof of an IgSF family member. In some aspects, the IgSF domain is an IgV domain or an IgC domain. In some aspects, the IgSF domain is an IgV domain or an IgC domain. In some aspects, the IRBM and/or ARBM is an IgSF domain of a IgSF family member that is a human protein and/or binds a human protein.

In some embodiments, the provided single-domain immunomodulatory proteins can include the ARBM or IRBM in various configurations or formats, including formats with one or more further moieties. The one or more ARBM or the one or more IRBM can be linked directly or indirectly, via a linker. In some embodiments, the single-domain immunomodulatory proteins can be formatted as multimeric molecules via fusion with a multimerization domain, such as an Fc protein. In some embodiments, the single-domain immunomodulatory proteins are formatted as a monomeric molecules containing single polypeptide fusions of the one or more ARBM or the one or more IRBM. In some embodiments, the single-domain immunomodulatory proteins can be formatted as multimeric molecules, e.g., dimeric, trimer, tetrameric, or pentameric molecules.

Exemplary ARBM or IRBM containing single-domain immunomodulatory proteins are described, as are exemplary formats for such single-domain immunomodulatory proteins.

III. FORMATS

1. Multi-Domain Immunomodulatory Protein Formats

The multi-domain immunomodulatory proteins containing one or more IRBM and one or more ARBM provided herein can be formatted in a variety of ways, including as a single chain polypeptide fusion or as a multimeric (e.g. dimeric, trimeric, tetrameric, or pentameric) molecules. In some cases, the immunomodulatory proteins can be formatted for secretion from a cell, such as for expression by an engineered cell or infectious agent as described elsewhere herein. The particular format is chosen such that the ARBM of the immunomodulatory protein specifically binds to the activating receptor or a ligand of the activating receptor and the IRBM specifically binds to the IRBM. In some aspects, the particular format is chosen to effect attenuation of an activity of the activating receptor, such as to reduce or decrease an immune response. In further aspects, the particular format is chosen to result in proximalization of the inhibitory receptor and activating receptor on an immune cell, e.g. T cell. In additional aspects, the particular format is chosen to recruit one or more phosphatase, e.g. SHP-1 or SHP-2, to the activating receptor and/or to result in phosphatase dependent dephosphorylation of the activating receptor.

In some embodiments, the format of the multi-domain immunomodulatory protein is chosen to avoid crosslinking or engagement of the activating receptor. Thus, in some aspects, the provided immunomodulatory proteins do not exhibit multivalent binding to the activating receptor. In some aspects, for the immunomodulatory proteins generated in a cis binding strategy (e.g. containing an IRBM that binds to an inhibitory receptor and an ARBM that binds to an activating receptor on the same cell, such as same T cell) a relatively smaller molecular weight, monomeric and/or single chain polypeptide fusion of the immunomodulatory protein is contemplated. In some embodiments, for the immunomodulatory proteins generated in a trans binding strategy (e.g. containing an IRBM that binds to an inhibitory receptor on a T cell and an ARBM that binds to a ligand of an activating receptor on an APC), it may not be necessary for the immunomodulatory protein to be formatted to minimize or avoid multivalent binding and/or to be of a smaller size. Hence, in some aspects, multi-domain immunomodulatory proteins that act in a trans binding strategy are formatted as dimeric proteins.

In some embodiments, the provided multi-domain immunomodulatory proteins can include one or more ARBM and one or more IRBM. In some embodiments, an immunomodulatory protein can include one or more ARBM described herein and any one or more IRBM described herein. In some embodiments, the immunomodulatory protein comprises exactly 1, 2, 3, 4, 5 ARBMs, which, in some aspects, are the same or are of identical sequence when a plurality are included. In some embodiments, each of a plurality of ARBM, e.g. 2, 3, 4, or 5, are linked directly or indirectly via a linker to another ARBM. In some aspects, at least one of the plurality of ARBM molecules are linked directly or indirectly via a linker to an IRBM.

In some embodiments, the immunomodulatory proteins comprises exactly 1, 2, 3, 4, 5 IRBMs, which, in some aspects, are the same or are of identical sequence when a plurality are included. In some embodiments, each of a plurality of IRBM, e.g. 2, 3, 4, or 5, are linked directly or indirectly via a linker to another IRBM. In some aspects, at least one of the plurality of IRBM molecules are linked directly or indirectly via a linker to an ARBM. In some embodiments, the modular format of the provided immunomodulatory proteins provides flexibility for engineering or generating immunomodulatory proteins for modulating activity at an immune synapse involving modulating interactions between and activating receptor and inhibitory receptor and their ligands.

In some embodiments, the multi-domain immunomodulatory protein contains a polypeptide that includes at least one ARBM and at least one IRBM. In some embodiments, the immunomodulatory protein includes a polypeptide containing an ARBM linked directly or indirectly via a linker to an IRBM, in either order. In some embodiments, at least one IRBM is amino terminal to at least one ARBM in the polypeptide. In some embodiments, at least one IRBM is carboxy terminal to at least one ARBM in the polypeptide.

In addition to single polypeptide chain embodiments, in some embodiments two, three, four, or more of a polypeptides containing one or more IRBM and/or one or more ARBM can be covalently or non-covalently attached to each other. In some embodiments, at least one polypeptide chain contains one or more IRBM and at least one polypeptide chain contains one or more ARBM. In some embodiments, each of at least two polypeptide chain contains at least one IRBM and at least one ARBM. Thus, monomeric, dimeric, and higher order (e.g., 3, 4, 5, or more) multimeric proteins are provided herein. For example, in some embodiments exactly two polypeptides, each containing one or more IRBM and/or one or more ARBM, can be covalently or non-covalently attached to each other to form a dimer. In some embodiments, the two polypeptides can be attached via a multimerization domain, in which, in some aspects, one or both of the IRBM and ARBM are linked directly or indirectly via a linker to the multimerization domain. In such embodiments, the multimerization domain can be the same or different. In some embodiments, the multimerization domain, such as an Fc region, facilitates attachment of two polypeptide chains via interchain cysteine disulfide bond. Compositions comprising two or more polypeptides can be of an identical sequence or substantially identical sequence of polypeptide (e.g., a homodimer) or of a non-identical sequence of polypeptides (e.g., a heterodimer).

In some embodiments, the multi-domain immunomodulatory protein can further include a tag or moiety.

Non-limiting examples of components for inclusion in provided formats are further described in section III.3.

2. Single-Domain Immunomodulatory Protein Formats

The single-domain immunomodulatory proteins containing one or more IRBM or one or more ARBM can be formatted in a variety of ways, including as a single chain polypeptide fusion or as a multimeric (e.g. dimeric, trimeric, tetrameric, or pentameric) molecules. In some cases, the immunomodulatory proteins can be formatted for secretion from a cell, such as for expression by an engineered cell or infectious agent as described elsewhere herein. In some aspects, the particular format is chosen to effect attenuation of an activity of the activating receptor, such as to reduce or decrease an immune response.

In some embodiments, the single-domain immunomodulatory protein includes a plurality of IRBM polypeptides, such as 2, 3, 4 or 5 IRBMs. In some embodiments, each of the IRBM is the same or has the same sequence. In some embodiments, each of a plurality of IRBM, e.g. 2, 3, 4, or 5, are linked directly or indirectly via a linker to another IRBM. In some aspects, at least one of the plurality of IRBM molecules are linked directly or indirectly via a linker to an ARBM.

In some embodiments, the single-domain immunomodulatory protein includes a plurality of ARBM polypeptides, such as 2, 3, 4 or 5 ARBM. In some embodiments, each of the ARBM is the same or has the same sequence. In some embodiments, each of a plurality of ARBM, e.g. 2, 3, 4, or 5, are linked directly or indirectly via a linker to another ARBM. In some aspects, at least one of the plurality of ARBM molecules are linked directly or indirectly via a linker to an IRBM.

In addition to single polypeptide chain embodiments, in some embodiments two, three, four, or more of a polypeptides containing one or more IRBM or one or more ARBM can be covalently or non-covalently attached to each other. In some embodiments, at least one polypeptide chain contains one or more IRBM. In some embodiments, at least one polypeptide chain contains one or more ARBM. Thus, monomeric, dimeric, and higher order (e.g., 3, 4, 5, or more) multimeric proteins are provided herein. For example, in some embodiments exactly two polypeptides, each containing one or more IRBM or one or more ARBM, can be covalently or non-covalently attached to each other to form a dimer. In some embodiments, the two polypeptides can be attached via a multimerization domain, in which, in some aspects, the IRBM or ARBM are linked directly or indirectly via a linker to the multimerization domain. In such embodiments, the multimerization domain can be the same or different. In some embodiments, the multimerization domain, such as an Fc region, facilitates attachment of two polypeptide chains via interchain cysteine disulfide bond. Compositions comprising two or more polypeptides can be of an identical sequence or substantially identical sequence of polypeptide (e.g., a homodimer) or of a non-identical sequence of polypeptides (e.g., a heterodimer).

In some embodiments, the single-domain immunomodulatory protein can further include a tag or moiety.

Non-limiting examples of components for inclusion in provided formats are further described in Section 111.3.

3. Components a. Linkers

For the multi-domain and single-domain immunomodulatory proteins provided herein, linkers, or spacers, can be used to connect components of a polypeptide, such as any ARBM and/or IRBM provided herein. In some cases, a linker is a peptide or polypeptide sequence {e.g. a synthetic peptide or polypeptide sequence), or is a non-peptide linker able to connect two moieties. In some aspects, a linker is used or chosen to maintain the structural flexibility and other conformational characteristics of the individual residues or at the secondary, tertiary, or quaternary structural levels of domains of the polypeptide fusion protein, such as in order to maintain functional properties of the immunomodulatory protein. Linkers can also provide additional beneficial properties to the protein, such as increased protein expression in mammalian expression systems, improved biophysical properties such as stability and solubility, improved protein purification and detection and/or increased enzymatic activity. In some examples, two or more linkers can be linked in tandem.

In some aspects, the linkers can be peptide linker. In other aspects, the linker includes chemical linking agents and heterobifunctional linking agents. In some cases, the linker is not cleavable. In other cases, a linker can contain one or more protease-cleavable sites, which can be located within the sequence of the linker or flanking the linker at either end of the linker sequence.

When multiple linkers are present in the immunomodulatory protein between ARBM, IRBM or other moieties, each of the linkers can be the same or different. Generally, linkers or multiple linkers provide flexibility to the polypeptide molecule.

In some embodiments, one or more "peptide linkers" link the ARBM, IRBM, or other moieties of the immunomodulatory protein. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is a flexible linker. Linking moieties are described, for example, in Huston et al. (1988) PNAS 85:5879-5883, Whitlow et al. (1993) Protein Engineering 6:989-995, and Newton et al, (1996) Biochemistry 35:545-553. Other suitable peptide linkers include any of those described in U.S. Pat. Nos. 4,751,180 or 4,935,233.

In some examples, a peptide linker includes peptides (or polypeptides) {e.g., natural, or non-naturally occurring peptides) which includes an amino acid sequence that links or genetically fuses a first linear sequence of amino acids to a second linear sequence of amino acids to which it is not naturally linked or genetically fused in nature. For example, the peptide linker can include non-naturally occurring polypeptides which are modified forms of naturally occurring polypeptides (e.g., that includes a mutation such as an addition, substitution or deletion). In another example, the peptide linker can include non-naturally occurring amino acids. In another example, the peptide linker can include naturally occurring amino acids occurring in a linear sequence that does not occur in nature. In still another example, the peptide linker can include a naturally occurring polypeptide sequence. Linking moieties can also include derivatives and analogs of the naturally occurring amino acids, as well as various non-naturally occurring amino acids (D- or L-), hydrophobic or non-hydrophobic, known in the art.

Exemplary peptide linkers are linkers with the formula $Ser(Gly_4Ser)_n$ (or $(Gly\text{-}Ser)_n$ residues with some Glu or Lys residues dispersed throughout to increase solubility, where n can be an integer from 1 to 20, such as 1, 2, 3, 4, 5, 6, 7, 8, 9, 10, 11, 12, 13, 14, 15, 16, 17, 18, 19, or 20. Other exemplary linkers include peptide linkers with the formula $[(Gly)_x\text{-}Ser_y]_z$ where x is from 1 to 4, y is 0 or 1, and z is from 1 to 50. In other examples, the peptide linker includes the sequence $G_n$, where n can be an integer from 1 to 100. In another example, the sequence of the peptide linker can be $(GA)_n$ or $(GGS)_n$.

In some embodiments, the linker is (in one-letter amino acid code): GGGGS ("4GS"; SEQ ID NO: 1942) or multimers of the 4GS linker, such as repeats of 2, 3, 4, or 5 4GS linkers. In some embodiments, the peptide linker is the peptide linker is $(GGGGS)_2$ or $(GGGGS)_3$ as set forth in SEQ ID NOs: 240 and 239, respectively. In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker is a rigid linker. For example, the linker is an $\alpha$-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 3240 (1×EAAAK), SEQ ID NO: 3241 (3×EAAAK) or SEQ ID NO: 3242 (5×EAAAK). In some embodiments, the linker can further include amino acids introduced by cloning and/or from a restriction site, for example the linker can include the amino acids GS (in one-letter amino acid code)

as introduced by use of the restriction site BAMHI. In some embodiments, the linker (in one-letter amino acid code) is GSGGGGS (SEQ ID NO: 1941) or GGGGSSA (SEQ ID NO: 2524). In some examples, the linker is a 2×GGGGS followed by three alanines (GGGGSGGGGSAAA; SEQ ID NO:241).

In some embodiments, a polynucleotide encoding a desired peptide linker can be inserted between, and in the same reading frame as a polynucleotide encoding any ARBM, IRBM or other moiety in the provided immunomodulatory protein and between another moiety, using any suitable conventional technique.

b. Multimerization Domain

In some embodiments, the immunomodulatory protein containing one or more ARBM(s) and/or IRBM(s) is multimeric, such as dimeric, trimeric, tetrameric, or pentameric. For the dimeric format, the immunomodulatory protein comprises a first polypeptide and a second polypeptide. In some embodiments, the first and/or second polypeptide is or contains an ARBM, IRBM, or both. In aspects, the ARBM and/or IRBM is linked, directly or indirectly via a linker, to a multimerization domain. In some aspects, the mutlimerization domain increase half-life of the molecule.

In one example, the immunomodulatory protein provided herein is a dimer. In some cases, the immunomodulatory protein is a homodimer that contains a first and second polypeptide subunit that are the same, i.e. each has the same amino acid sequence containing the identical IRBM(s) and ARBM(s). The homodimer can be formed by transforming a nucleic acid molecule encoding the variant polypeptide into a cell, which, upon secretion, results in covalent or non-covalent interaction between residues of polypeptide subunits to mediate formation of the dimer.

In another example, the immunomodulatory protein is a heterodimer that contains a first and second polypeptide subunit that are different. In such an example, one or both of the first or second polypeptide subunit contains a sequence of amino acids of an ARBM and IRBM. In some cases, both the first and second polypeptide subunit can contain a sequence of amino acids of an ARBM and a sequence of amino acids of an IRBM. The heterodimer can be formed by transforming into a cell both a first nucleic acid molecule encoding a first polypeptide subunit and a second nucleic acid molecule encoding a second different polypeptide subunit. In some aspects, the heterodimer is produced upon expression and secretion from a cell as a result of covalent or non-covalent interaction between residues of the two polypeptide subunits to mediate formation of the dimer. In such processes, generally a mixture of dimeric molecules is formed, including homodimers and heterodimers. For the generation of heterodimers, additional steps for purification can be necessary. For example, the first and second polypeptide can be engineered to include a tag with metal chelates or other epitope, where the tags are different. The tagged domains can be used for rapid purification by metal-chelate chromatography, and/or by antibodies, to allow for detection by western blots, immunoprecipitation, or activity depletion/blocking in bioassays.

Interaction of two or more polypeptides of the immunomodulatory proteins can be facilitated by their linkage, either directly or indirectly, to any moiety or other polypeptide that are themselves able to interact to form a stable structure. For example, separate encoded polypeptide chains can be joined by multimerization, whereby multimerization of the polypeptides is mediated by a multimerization domain. Typically, the multimerization domain provides for the formation of a stable protein-protein interaction between a first polypeptide and a second polypeptide.

In some embodiments, the two or more individual polypeptides of the immunomodulatory proteins can be joined by multimerization, such as joined as dimeric, trimeric, tetrameric, or pentameric molecules. In some cases, the individual polypeptides are the same. For example, a trimeric molecule can be formed from three copies of the same individual polypeptide. In other examples, a tetrameric molecule is generated from four copies of the same individual polypeptides. In further examples, a pentameric molecule is generated from five copies of the same individual polypeptides. In some embodiments of the configurations, the individual polypeptides of an immunomodulatory proteins containing an ARBM and/or IRBM are fused to a multimerization domain. In some cases, the individual polypeptides of a multi-domain immunomodulatory protein containing an ARBM and IRBM are fused to a multimerization domain. In some examples, the individual polypeptides of a single-domain immunomodulatory proteins containing an ARBM or IRBM are fused to a multimerization domain, such as a multimerization domain that promotes trimerization, tetramerization, or pentamerization of the proteins.

In some embodiments, a multimerization domain includes any capable of forming a stable protein-protein interaction. The multimerization domains can interact via an immunoglobulin sequence (e.g. Fc domain; see e.g., International Patent Pub. Nos. WO 93/10151 and WO 2005/063816 US; U.S. Pub. No. 2006/0024298; U.S. Pat. No. 5,457,035); leucine zipper (e.g. from nuclear transforming proteins fos and jun or the proto-oncogene c-myc or from General Control of Nitrogen (GCN4)) (ee e.g., Busch and Sassone-Corsi (1990) Trends Genetics, 6:36-40; Gentz et al., (1989) Science, 243:1695-1699); a hydrophobic region; a hydrophilic region; or a free thiol which forms an intermolecular disulfide bond between the chimeric molecules of a homo- or heteromultimer. In addition, a multimerization domain can include an amino acid sequence comprising a protuberance complementary to an amino acid sequence comprising a hole, such as is described, for example, in U.S. Pat. No. 5,731,168; International Patent Pub. Nos. WO 98/50431 and WO 2005/063816; Ridgway et al. (1996) Protein Engineering, 9:617-621. Such a multimerization region can be engineered such that steric interactions not only promote stable interaction, but further promote the formation of heterodimers over homodimers from a mixture of chimeric monomers. Generally, protuberances are constructed by replacing small amino acid side chains from the interface of the first polypeptide with larger side chains (e.g., tyrosine or tryptophan). Compensatory cavities of identical or similar size to the protuberances are optionally created on the interface of the second polypeptide by replacing large amino acid side chains with smaller ones (e.g., alanine or threonine). Exemplary multimerization domains are described below.

The ARBM and/or IRBM can be joined anywhere, but typically via its N- or C-terminus, to the N- or C-terminus of a multimerization domain to form a chimeric polypeptide. The linkage can be direct or indirect via a linker. Also, the chimeric polypeptide can be a fusion protein or can be formed by chemical linkage, such as through covalent or non-covalent interactions. For example, when preparing a chimeric polypeptide containing a multimerization domain, nucleic acid encoding all or part of an ARBM and/or IRBM can be operably linked to nucleic acid encoding the multimerization domain sequence, directly or indirectly or optionally via a linker domain. In some cases, the construct encodes a chimeric protein where the C-terminus of the ARBM and/or IRBM is joined to the N-terminus of the multimerization domain. In some instances, a construct can encode a chimeric protein where the N-terminus of the ARBM and/or IRBM is joined to the N- or C-terminus of the multimerization domain.

A polypeptide multimer contains two chimeric proteins created by linking, directly or indirectly, two of the same or different ARBM and/or IRBM directly or indirectly to a multimerization domain. In some examples, where the multimerization domain is a polypeptide, a gene fusion encoding the ARBM and/or IRBM and multimerization domain is inserted into an appropriate expression vector. The resulting chimeric or fusion protein can be expressed in host cells transformed with the recombinant expression vector, and allowed to assemble into multimers, where the multimerization domains interact to form multivalent polypeptides. Chemical linkage of multimerization domains to the ARBM and/or IRBM can be effected using heterobifunctional linkers.

The resulting chimeric polypeptides, such as fusion proteins, and multimers formed therefrom, can be purified by any suitable method such as, for example, by affinity chromatography over Protein A or Protein G columns. Where two nucleic acid molecules encoding different polypeptides are transformed into cells, formation of homo- and heterodimers will occur. Conditions for expression can be adjusted so that heterodimer formation is favored over homodimer formation.

In some embodiments, the immunomodulatory protein comprises an ARBM and/or IRBM attached to an immunoglobulin Fc (yielding an "immunomodulatory Fc fusion.") In some embodiments, the attachment of the ARBM and/or IRBM is at the N-terminus of the Fc. In some embodiments, the attachment of the ARBM and/or IRBM is at the C-terminus of the Fc. In some embodiments, two or more ARBM and/or IRBM (the same or different) are independently attached at the N-terminus and at the C-terminus. Thus, homo- or heteromultimeric polypeptides can be generated from co-expression of separate ARMB and/or IRBM containing polypeptides. The first and second polypeptides can be the same or different. In some embodiments, the first and/or second polypeptide each contains two or more ARBM and/or IRBM linked to the Fc sequence. In some embodiments, the first and/or second polypeptide each contains three IRBMs and one ARBM linked to the Fc sequence.

In some embodiments, the Fc is murine or human Fc. In some embodiments, the Fc is a mammalian or human IgG1, lgG2, lgG3, or lgG4 Fc regions. In some embodiments, the Fc is derived from IgG1, such as human IgG1. In some embodiments, the Fc comprises the amino acid sequence set forth in SEQ ID NO: 187 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 187.

In some embodiments, the Fc region contains one more modifications to alter (e.g. reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. Additionally, the FcRn sequence present in the Fc region plays the role of regulating the IgG level in serum by increasing the in vivo half-life by conjugation to an in vivo FcRn receptor. In some embodiments, such functions can be reduced or altered in an Fc for use with the provided Fc fusion proteins.

In some embodiments, one or more amino acid modifications may be introduced into the Fc region, thereby generating an Fc region variant. In some embodiments, the Fc region variant has decreased effector function. There are many examples of changes or mutations to Fc sequences that can alter effector function. For example, WO 00/42072, WO2006019447, WO2012125850, WO2015/107026, US2016/0017041 and Shields et al. *J Biol. Chem.* 9(2): 6591-6604 (2001) describe exemplary Fc variants with improved or diminished binding to FcRs. The contents of those publications are specifically incorporated herein by reference.

In some embodiments, the provided immunomodulatory proteins comprise an Fc region that exhibits reduced effector functions, which makes it a desirable candidate for applications in which the half-life of the immunomodulatory protein in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the immunomodulatory protein lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII FcR expression on hematopoietic cells is summarized in Table 2 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J. Exp. Med.* 166:1351-1361 (1987)). Alternatively, non-radioactive assay methods may be employed (see, for example, ACTI™ non-radioactive cytotoxicity assay for flow cytometry (CellTechnology, Inc. Mountain View, Calif.; and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the immunomodulatory protein n is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103:2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

Immunomodulatory protein with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of immunomodulatory proteins has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268Q/V309L/A330S/A331S, IgG4-L235A/G237A/E318A, and IgG4-L236E described in Current Opinion in Biotechnology (2009) 20 (6), 685-691; alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006019447 and Shields et al., *J. Biol. Chem.* 9(2): 6591-6604 (2001).)

In some embodiments, there is provided an immunomodulatory protein comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of the immunomodulatory protein comprises one or more amino acid substitution E356D and M358L by EU numbering. In some embodiments, the Fc region of the immunomodulatory protein comprises one or more amino acid substitutions C220S, C226S and/or C229S by EU numbering. In some embodiments, the Fc region of the immunomodulatory protein comprises one or more amino acid substitutions R292C and V302C. See also Duncan & Winter, *Nature* 322:738-40 (1988); U.S. Pat. Nos. 5,648,260; 5,624,821; and WO 94/29351 concerning other examples of Fc region variants.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., *J. Immunol.* 164: 4178-4184 (2000).

In some embodiments, there is provided an immunomodulatory protein comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 187. In some embodiments, the Fc contains at least one amino acid substitution that is N82G by numbering of SEQ ID NO: 187 (corresponding to N297G by EU numbering). In some embodiments, the Fc further contains at least one amino acid substitution that is R77C or V87C by numbering of SEQ ID NO: 187 (corresponding to R292C or V302C by EU numbering). In some embodiments, the variant Fc region further comprises a C5S amino acid modification by numbering of SEQ ID NO: 187 (corresponding to C220S by EU numbering). For example, in some embodiments, the variant Fc region comprises the following amino acid modifications: V297G and one or more of the following amino acid modifications C220S, R292C or V302C by EU numbering (corresponding to N82G and one or more of the following amino acid modifications C5S, R77C or V87C with reference to SEQ ID NO:187), e.g., the Fc region comprises the sequence set forth in SEQ ID NO:1157. In some embodiments, the variant Fc region comprises one or more of the amino acid modifications C220S, L234A, L235E or G237A, e.g. the Fc region comprises the sequence set forth in SEQ ID NO:1158. In some embodiments, the variant Fc region comprises one or more of the amino acid modifications C220S, L235P, L234V, L235A, G236del or S267K, e.g. the Fc region comprises the sequence set forth in SEQ ID NO:1159. In some embodiments, the variant Fc comprises one or more of the amino acid modifications C220S, L234A, L235E, G237A, E356D or M358L, e.g. the Fc region comprises the sequence set forth in SEQ ID NO:1155.

In some embodiments, the Fc region lacks the C-terminal lysine corresponding to position 232 of the wild-type or unmodified Fc set forth in SEQ ID NO: 187 (corresponding to K447del by EU numbering). In some aspects, such an Fc region can additionally include one or more additional modifications, e.g. amino acid substitutions, such as any as described. Exemplary of such an Fc region is set forth in SEQ ID NO: 1938, 1939, 1940, or 1715.

In some embodiments, there is provided an immunomodulatory protein comprising a variant Fc region in which the variant Fc comprises the sequence of amino acids set forth in any of SEQ ID NOS:1155, 1157, 1158, 1159, 1715, 1938, 1939, or 1940 or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 1155, 1157, 1158, 1159, 1715, 1938, 1939, or 1940.

In some embodiments, the Fc is derived from IgG2, such as human IgG2. In some embodiments, the Fc comprises the amino acid sequence set forth in SEQ ID NO: 188 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 188.

In some embodiments, the Fc comprises the amino acid sequence set forth in SEQ ID NO: 1200 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1200. In some embodiments, the IgG4 Fc is a stabilized Fc in which the CH3 domain of human IgG4 is substituted with the CH3 domain of human IgG1 and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see e.g. U.S. Pat. No. 8,911,726. In some embodiments, the Fc is an IgG4 containing the S228P mutation, which has been shown to prevent recombination between a therapeutic antibody and an endogenous IgG4 by Fab-arm exchange (see e.g. Labrijin et al. (2009) Nat. Biotechnol., 27(8): 767-71.) In some embodiments, the Fc comprises the amino acid sequence set forth in SEQ ID NO: 1201 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 1201.

In some embodiments, the immunomodulatory protein is a homodimer that contains a first immunomodulatory Fc fusion polypeptide and a second immunomodulatory Fc fusion polypeptide in which the first and second polypeptide are the same. In some embodiments, a first Fc polypeptide fusion contains an Fc region and one or more ARBM and/or IRBM and a second polypeptide fusion contains an Fc region and one or more ARBM and/or IRBM. In such embodiments, the Fc region can be any as described above.

In some embodiments, the immunomodulatory protein contains a first immunomodulatory Fc fusion polypeptide and a second immunomodulatory Fc fusion polypeptide in which the first and second polypeptide are different. In some embodiments, a first Fc polypeptide fusion contains an Fc region and one or more ARBM and/or IRBM and a second polypeptide fusion contains an Fc region and one or more ARBM and/or IRBM. In such embodiments, the Fc region can be a region that promotes or facilitates formation of heterodimers.

In some embodiments, a sequence of amino acids is added preceding the Fc sequence for constructs in which the Fc sequence is the N-terminal portion of the sequence. In some cases, the sequence of amino acids HMSSVSAQ (SEQ ID NO:1156) is added immediately preceding the Fc sequence for constructs in which the Fc sequence is N-terminal portion of the sequence.

In some embodiments, the Fc domain of one or both of the first and second immunomodulatory Fc fusion polypeptides comprise a modification (e.g. substitution) such that the interface of the Fc molecule is modified to facilitate and/or promote heterodimerization. Methods to promote heterodimerization of Fc chains include mutagenesis of the Fc region, such as by including a set of "knob-into-hole" mutations or including mutations to effect electrostatic steering of the Fc to favor attractive interactions among different polypeptide chains.

In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tryptophan (W). In some examples, the original residue identified for replacement is an amino acid residue that has a small side chain such as, for example, alanine, asparagine, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 A2 from each surface (see e.g., Deisenhofer et al. (1981) Biochemistry, 20:2361-2370; Miller et al., (1990) J Mol. Biol., 216, 965-973; Ridgway et al., (1996) Prot. Engin., 9: 617-621; U.S. Pat. No. 5,731, 168). Modifications of a CH3 domain to create protuberances or cavities are described, for example, in U.S. Pat. No. 5,731,168; International Patent Applications WO98/50431 and WO 2005/063816; and Ridgway et al., (1996) Prot. Engin., 9: 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant, A. M., et al., Nature Biotech. 16 (1998) 677-681) e.g. by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g. as described by EP 1 870 459 A1.

In some embodiments, an Fc variant containing CH3 protuberance (knob) or cavity (hole) modifications can be joined to a multi-domain immunomodulatory polypeptide anywhere, but typically via its N- or C-terminus, to the N- or C-terminus of the one or more ARBM or IRBM, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s). In some embodiments, the knob or hold Fc region lacks the C-terminal lysine corresponding to position 232 of the wild-type or unmodified Fc set forth in SEQ ID NO: 187 (corresponding to K447del by EU numbering). Exemplary sequences for knob and hole Fc polypeptides are set forth in SEQ ID NOs: 1153, 1154, 2558, and 2559. In some embodiments, a heterodimeric stack molecule contains a first Fc polypeptide fusion containing an Fc region (knob) and a first variant polypeptide and/or second IgSF domain (e.g. second variant IgSF domain) and a second Fc polypeptide fusion containing an Fc region (hole) contains a stuffer sequence HMSSVSAQ (SEQ ID NO:1156) immediately preceding both Fc regions of the first and second Fc polypeptide fusion.

In some embodiments, the Fc region of each polypeptide of a heterodimer includes a mutation to altered charge polarity across the Fc dimer interface such that coexpression of electrostatically matched Fc chains support favorable attractive interactions thereby promoting desired Fc heterodimer formation, whereas unfavorable repulsive charge interactions suppress unwanted Fc homodimer formation (Guneskaran et al. (2010) JBC, 285: 19637-19646). In some embodiments, at least one polypeptide containing an ARBM and/or IRBM is linked directly or indirectly to an Fc containing mutations to positively charged residues (e.g. E356K, E357K and/or D399K by EU numbering; designated K chain set forth), such as set forth in SEQ ID NO:2544. In such embodiments, the other polypeptide of the heterodimer containing an ARBM and/or IRBM is linked directly or indirectly to an Fc containing mutations to negatively charged residues (e.g. K370D, K392D and K409D by EU numbering; designated D chain), such as set forth in SEQ ID NO:2545. When co-expressed in a cell, association between the K and D chains is possible but the chains do not substantially self-associate due to charge repulsion.

In some embodiments, any of the above mutations in an Fc backbone can be made in an allotype containing residues Glu (E) and Met (M) at positions 356 and 358.

In some embodiments, the Fc region of the heterodimeric molecule additionally can contain one or more other Fc mutation, such as any described above. In some embodiments, the heterodimer molecule contains an Fc region with a mutation that reduces effector function. In some embodiments, such Fc regions contain mutations C220S, L234A, L235E and/or G237A by EU numbering.

In some embodiments, the wild-type IgG1 Fc can be the Fc set forth in SEQ ID NO: 187 having an allotype containing residues Glu (E) and Met (M) at positions 356 and 358 by EU numbering. In other embodiments, the wild-type IgG1 Fc contains amino acids of the human G1m1 allotype, such as residues containing Asp (D) and Leu (L) at positions 356 and 358, e.g. as set forth in SEQ ID NO:3538. Thus, in some cases, an Fc provided herein can contain amino acid substitutions E356D and M358L to reconstitute residues of allotype G1 ml. In some aspects, a wild-type Fc is modified by one or more amino acid substitutions to reduce effector activity or to render the Fc inert for Fc effector function. Exemplary effectorless or inert mutations include those described herein. Among effectorless mutations that can be included in an Fc of constructs provided herein are L234A, L235E and G237A by EU numbering. In some embodiments, a wild-type Fc is further modified by the removal of one or more cysteine residue, such as by replacement of the cysteine residues to a serine residue at position 220 (C220S) by EU numbering. Exemplary inert Fc regions having reduced effector function are set forth in SEQ ID NO: 1158 and SEQ ID NO:3579, which are based on allotypes set forth in SEQ ID NO:187 or SEQ ID NO: 3538, respectively. In some embodiments, an Fc region used in a construct provided herein can further lack a C-terminal lysine residue.

In some configurations, a first and second polypeptide of a heterodimeric Fc fusion protein can be linked to a moiety for detection and/or purification. In some aspects, the first and second polypeptide are linked to different tags or moieties. In some aspects, the tag or moiety of the first and second polypeptide is independently selected from a poly-histidine tag (HHHHHH; SEQ ID NO: 2011), a flag-tag (DYKDDDDK; SEQ ID NO: 2010), a Myc-tag, or fluorescent protein-tags (e.g., EGFP, set forth in SEQ ID NOs: 3042, 3049, or 3243). In some examples, the first polypeptide containing an ARBM and the second polypeptide containing an IRBM each further contain a moiety for detection and/or purification, such as a poly-histidine tag (HHHHHH; SEQ ID NO: 2011) and/or a flag-tag (DYKDDDDK; SEQ ID NO: 2010).

In some embodiments, the ARBM and/or IRBM is directly linked to the Fc sequence. In some embodiments, the ARBM and/or IRBM is indirectly linked to the Fc sequence, such as via a linker. In some embodiments, one or more "peptide linkers" link the ARBM and/or IRBM and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. Exemplary linkers are set forth in subsection "Linker."

In some embodiments, the immunomodulatory protein forms a multimer, e.g., a dimer. In some embodiments, the dimer is a homodimer in which the two polypeptides of the immunomodoulatory protein are the same. In some embodiments, the dimer is a heterodimer in which the two polypeptides of the immunomodoulatory protein are different.

In some embodiment, individual polypeptide of a multi-domain polypeptide or individual polypeptides of a single-domain polypeptide are linked to a multimerization domain that forms an immimmunomodulatory protein is a trimer, tetramer or pentamer. In some embodiments, the individual polypeptides of such a molecule are the same. In some embodiments, such a multimerization domain is a cartilage oligomeric matrix protein (COMP) assembly domain, a vasodilator-stimulated phosphoprotein (VASP) tetramerization domain or a ZymoZipper (ZZ) 12.6 domain.

In some embodiments, the multimerization domain is a portion of the cartilage oligomeric matrix protein (COMP) assembly domain (Voulgaraki et al., Immunology (2005) 115(3):337-346. In some examples, the COMP is or contains an amino acid sequence as set forth in SEQ ID NO: 3503 (e.g. amino acids 29-72 of the full length COMP, Uniprot accession number P49747) or a sequence that has 85%, 85%, 87%, 88%, 89%, 90%, 91%, 92%, 93%, 94%, 95%, 96%, 97%, 98%, 99% or more sequence identity to SEQ ID NO: 3503.

In some embodiments, the multimerization domain is a vasodilator-stimulated phosphoprotein (VASP) tetramerization domain (Bachmann et al., J Biol Chem (1999) 274(33): 23549-23557). In some embodiments, the VASP is or contains an amino acid sequence as set forth in SEQ ID NO:

3504 (e.g. amino acids 343-375 of the full length VASP; Uniprot accession number P50552) or a sequence that has 85%, 85%, 87%, 88%, 89%, 90%, 91%, 92%, 93%, 94%, 95%, 96%, 97%, 98%, 99% or more sequence identity to SEQ ID NO: 3504.

In some embodiments, the multimerization domain is a ZymoZipper (ZZ) 12.6 domain. In some embodiments, the ZZ domain is or contains an amino acid sequence as set forth in SEQ ID NO: 3505 (See U.S. Pat. No. 7,655,439) or a sequence that has 85%, 85%, 87%, 88%, 89%, 90%, 91%, 92%, 93%, 94%, 95%, 96%, 97%, 98%, 99% or more sequence identity to SEQ ID NO: 3505.

Also provided are nucleic acid molecules encoding the immunomodulatory protein. In some embodiments, for production of immunomodulatory protein, a nucleic acid molecule encoding the immunomodulatory protein is inserted into an appropriate expression vector. The resulting immunomodulatory protein can be expressed in host cells transformed with the expression where assembly between Fc domains occurs by interchain disulfide bonds formed between the Fc moieties to yield dimeric, such as divalent, immunomodulatory proteins.

The resulting immunomodulatory protein containing an ARBM, IRBM, and Fc, can be easily purified by affinity chromatography over Protein A or Protein G columns. For the generation of heterodimers, additional steps for purification can be necessary. For example, where two nucleic acids encoding different immunomodulatory proteins are transformed into cells, the formation of heterodimers must be biochemically achieved since immunomodulatory protein carrying the Fc-domain will be expressed as disulfide-linked homodimers as well. Thus, homodimers can be reduced under conditions that favor the disruption of interchain disulfides, but do no effect intra-chain disulfides. In some cases, different immunomodulatory protein monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing immunomodulatory proteins containing Fc fusion molecules that contain one or more ARBM and/or IRBM using knob-into-hole methods described below.

c. Tags or Moieties

In some embodiments, the one or more polypeptides containing an ARBM and/or IRBM in the provided immunomodulatory proteins can further include a tag or moiety. In some embodiments, the further moiety is a protein, peptide, small molecule or nucleic acid. In some cases, the immunomodulatory protein is linked, directly or indirectly to more than one further moiety, such as 2, 3, 4, 5, or 6, further moieties.

In some embodiments, the moiety is a half-life extending molecule. Exemplary of such half-life extending molecules include, but are not limited to, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof.

In some embodiments, the immunomodulatory polypeptide comprising an ARBM and/or IRBM can include conformationally disordered polypeptide sequences composed of the amino acids Pro, Ala, and Ser (See e.g., WO2008/155134, SEQ ID NO: 904). In some cases, the amino acid repeat is at least 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid residues, wherein each repeat comprises (an) Ala, Ser, and Pro residue(s). Thus, provided herein is an immunomodulatory protein is a PASylated protein wherein the ARBM and/or IRBM are linked, directly or indirectly via a linker, to Pro/Ala/Ser (PAS). In some embodiments, one or more additional linker structures may be used.

In some embodiments, the moiety facilitates detection or purification of the immunomodulatory protein. In some cases, the immunomodulatory protein, such as at least one of or each polypeptide of a multimer (e.g. dimer, trimer, tetramer, or pentamer) thereof, comprises a tag or moiety, e.g. affinity or purification tag, linked. In some aspects, such a tag or moiety can be linked directly or indirectly via a linker to the N- and/or c-terminus of the polypeptide. Various suitable polypeptide tags and/or fusion domains are known, and include but are not limited to, a poly-histidine (His) tag, a FLAG-tag (SEQ ID NO: 2010), a Myc-tag, and fluorescent protein-tags (e.g., EGFP, set forth in SEQ ID NOs:3042, 3049, or 3243). In some cases, the tag is a His tag containing at least six histidine residues (set forth in SEQ ID NO: 2011).

In some cases, the immunomodulatory protein comprising an ARBM and IRBM further comprises various combinations of moieties. For example, the immunomodulatory protein comprising an ARBM or IRBM further comprises one or more polyhistidine-tag and FLAG tag. In some cases, the combination of moieties, such as two or more moieties, can be included on the same polypeptide. In some cases, the combination of moieties, such as two or more moieties, can be included on different polypeptide, such as in connection with embodiments relating to heterodimeric immunomodulatory polypeptides.

IV. NUCLEIC ACIDS, VECTORS AND METHODS FOR PRODUCING THE POLYPEPTIDES OR CELLS

Provided herein are isolated or recombinant nucleic acids collectively referred to as "nucleic acids" which encode any of the immunomodulatory proteins provided herein. In some embodiments, nucleic acids provided herein, including all described below, are useful in recombinant production (e.g., expression) of immunomodulatory proteins provided herein. In some embodiments, nucleic acids provided herein, including all described below, are useful in expression of multi-domain immunomodulatory proteins provided herein in cells, such as in engineered cells, e.g. immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the multi-domain immunomodulatory proteins provided herein.

Also provided herein are engineered cells, such as engineered immune cells, containing any of the provided nucleic acids or encoded multi-domain immunomodulatory proteins, such as any of the transmembrane immunomodulatory polypeptides or secretable immunomodulatory polypeptides.

Also provided herein are infectious agents, such as bacterial or viral cells, containing any of the provided nucleic acids or encoded multi-domain immunomodulatory proteins, such as any of the secretable immunomodulatory polypeptides.

In any of the above provided embodiments, the nucleic acids encoding the immunomodulatory polypeptides provided herein can be introduced into cells using recombinant DNA and cloning techniques. To do so, a recombinant DNA molecule encoding an immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more multi-domain immunomodulatory proteins containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promotor (such as a tissue-specific constitutively active promotor or other constitutive promotor). In some embodiments, the promoter is a tissue- or cell-specific promoter to restrict expression to specific cell types (e.g., T cells) or tissues. In some embodiments the nucleic acid molecule includes tissue-specific promoters and enhancers. Exemplary tissue-specific promoters, target tissues and autoimmune diseases associated with the specified target tissue(s) are set forth in Table 11.

TABLE 11

| Promoter | Target tissue | Disease |
|---|---|---|
| Tissue-specific promoters | | |
| Salivary gland amylase promoter | Salivary gland; Epithelial cells acinar | Sjogren's syndrome |
| Kallikrein promoter | Salivary gland; Epithelial cells ductal | Sjogren's syndrome |
| Involucrin promoter | Keratinocyte | Scleroderma |
| Keratin 14 promoter | Basal layer of epidermis | Scleroderma |
| Murine albumin gene | Liver (hepatocytes) | Diabetes and other autoimmune diseases |
| L-type pyruvate kinase promoter | Liver (hepatocytes) | Diabetes and other autoimmune diseases |
| Rat insulin promoter | Pancreatic β-islet cells | Diabetes |
| Collagen II promoter | Joints (chondrocytes) | Rheumatoid Arthritis |
| Human glial fibrillary acidic protein promoter | Brain (astrocytes) | Multiple Sclerosis |
| Neuron-specific enolase promoter | Brain (neurones) | Multiple Sclerosis |
| Targeting immune cells | | |
| Interleukin-2 promoter | Activated T cells | All autoimmune diseases |
| MHC-II specific HLA-DRα promoter | APC | All autoimmune diseases |
| Dectin-2 promoter | Langerhans cells; (Dendritic cells) | All autoimmune diseases |
| GATA-1 enhancer + lentiviral LTR | Erythroid cells | All autoimmune diseases |

In some embodiments, the promotor is an inducible promotor, which may be responsive to an inducing agent (such as a T cell activation signal) or a condition of a targeted environment, such as hypoxia.

In some embodiments the nucleic acid molecule includes a condition-dependent promoter. In such embodiments a promoter is selected to regulate gene expression in a disease-related manner. Exemplary condition-dependent promoters include hypoxic gene regulatory systems that utilize one or more hypoxic response elements (HRE) and transcription mediated by the transcription factor HIF-1, which is assembled under hypoxic conditions, such as during inflammation, e.g., in inflamed joints. In some embodiments, glucose or insulin-responsive promoters or elements, such as glucose response elements (GRE) and/or insulin-like growth factor binding protein-1 basal promoter, can be included in the provided nucleic acid molecules, for use or administration, for example, to patients with a glucose-related disorder, such as diabetes.

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EF1a) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g. published International PCT Appl. No. WO 01/30843), to allow regulated expression of the encoded polypeptide. An exemplary regulatable promoter system is the Tet-On (and Tet-Off) system available, for example, from Clontech (Palo Alto, CA). This promoter system allows the regulated expression of the transgene controlled by tetracycline or tetracycline derivatives, such as doxycycline. Other regulatable promoter systems are known (see e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors). Other exemplary inducible promoters of the tetracycline systems include repressor (tetR), rapamycin, ecdysone, mifepristone, and streptogramin systems.

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promotor.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof. "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. In some embodiments, the host cell is a suspension cell and the polypeptide is engineered or produced in cultured suspension, such as in cultured suspension CHO cells, e.g.

CHO—S cells. In some examples, the cell line is a CHO cell line that is deficient in DHFR (DHFR−), such as DG44 and DUXB11. In some embodiments, the cell is deficient in glutamine synthase (GS), e.g. CHO—S cells, CHOK1 SV cells, and CHOZN((R)) GS−/− cells. In some embodiments, the CHO cells, such as suspension CHO cells, may be CHO—S-2H2 cells, CHO—S-clone 14 cells, or ExpiCHO—S cells.

In some embodiments, host cells can also be prokaryotic cells, such as with *E. coli*. The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cell, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g. transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequences encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., J. Virol. 80:985-98 (2006); Tartaglia et al., AIDS Research and Human Retroviruses 8: 1445-47 (1992); Gheradi et al., J. Gen. Virol. 86:2925-36 (2005); Mayr et al., Infection 3:6-14 (1975); Hu et al., J. Virol. 75: 10300-308 (2001); U.S. Pat. Nos. 5,698,530, 6,998,252, 5,443,964, 7,247,615 and 7,368,116); adenovirus vector or adenovirus-associated virus vectors (see, e.g., Molin et al., J. Virol. 72:8358-61 (1998); Narumi et al., Am J. Respir. Cell Mol. Biol. 19:936-41 (1998); Mercier et al., Proc. Natl. Acad. Sci. USA 101:6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., J. Virol. 66:2731-39 (1992); Johann et al., J. Virol. 66: 1635-40 (1992); Sommerfelt et al., Virology 176:58-59 (1990); Wilson et al., J. Virol. 63:2374-78 (1989); Miller et al., J. Virol. 65:2220-24 (1991); Miller et al., Mol. Cell Biol. 10:4239 (1990); Kolberg, NIH Res. 4:43 1992; Cornetta et al., Hum. Gene Ther. 2:215 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer et al., Annu. Rev. Genomics Hum. Genet. 2: 177-211 (2001); Zufferey et al., J. Virol. 72: 9873, 1998; Miyoshi et al., J. Virol. 72:8150, 1998; Philpott and Thrasher, Human Gene Therapy 18:483, 2007; Engelman et al., J. Virol. 69: 2729, 1995; Nightingale et al., Mol. Therapy, 13: 1121, 2006; Brown et al., J. Virol. 73:9011 (1999); WO 2009/076524; WO 2012/141984; WO 2016/011083; McWilliams et al., J. Virol. 77: 11150, 2003; Powell et al., J. Virol. 70:5288, 1996) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promotor is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., Mol. Cell. Biol. 12:1043-53 (1992); Todd et al., J. Exp. Med. 177: 1663-74 (1993); Penix et al., J. Exp. Med. 178:1483-96 (1993)). In some embodiments, the promotor is an inducible promotor, which may be responsive to an inducing agent (such as a T cell activation signal). In some embodiments, nucleic acids delivered to the target cell in the subject, e.g., immune cell, cell localized to an inflammatory environment, and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., immune cells, cells localized to an inflammatory environment, and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

V. ENGINEERED CELLS AND INFECTIOUS AGENTS EXPRESSING THE IMMUNOMODULATORY PROTEINS

Provided herein are engineered cells and infectious agents that express the provided multi-domain immunomodulatory proteins. In some embodiments, provided are engineered cells that contain nucleic acid(s) encoding any of the multi-domain immunomodulatory proteins provided herein. Also provided are infectious agents that contain nucleic acids encoding any of the multi-domain immunomodulatory proteins. In some embodiments, such infectious agents can deliver the nucleic acids encoding the multi-domain immunomodulatory proteins described herein to a target cell in a subject, e.g., immune cell and/or antigen-presenting cell (APC) or tumor cell in a subject. In some embodiments, the expressed immunomodulatory protein is a secretable protein that is expressed and secreted from the cell or infectious agent. Also provided are nucleic acids contained in such engineered cells and infectious agents, and/or nucleic acids for generation or modification of such engineered cells or infectious agents, such as vectors and/or plasmids, and compositions containing such engineered cells or infectious agents.

A. Secreted Immunomodulatory Proteins

In some embodiments, the multi-domain immunomodulatory protein is secretable, such as when expressed from a cell or when expressed by a cell infected by an infectious agent. In some embodiments, such a secretable immunomodulatory protein does not comprise a transmembrane domain or a cytoplasmic signaling domain. In some embodiments, the immunomodulatory protein is not conjugated to a half-life extending moiety (such as an Fc domain or a multimerization domain). In some embodiments, the immunomodulatory protein comprises a signal peptide, such as an antibody signal peptide or other efficient signal sequence to get domains outside of cell. When the immunomodulatory protein comprises a signal peptide and is expressed by an engineered cell or a cell infected by an infectious agent, the signal peptide causes the immunomodulatory protein to be secreted by the cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided multi-domain immunomodulatory proteins that further comprise a signal peptide. In some embodiments, provided herein is a nucleic acid molecule encoding the multi-domain immunomodulatory protein operably connected to a secretion sequence encoding the signal peptide. In some embodiments, the encoded immunomodulatory protein is secreted when expressed from a cell.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from one of the corresponding native IgSF family members of the multi-domain immunomodulatory protein (see Table 1, Table 6A or Table 6B). In some embodiments, the signal peptide is a non-native signal peptide. In some embodiments, the non-native signal peptide is a signal peptide or mutant thereof of a family member from the same IgSF family as the wild-type IgSF family member. In some embodiments, the non-native signal peptide is a signal peptide or mutant thereof from an IgSF family member from a different IgSF family that the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g. HSA or albumin), a human azurocidin preprotein signal sequence, a luciferase, a trypsinogen (e.g. chymotrypsinogen or trypsinogen) or other signal peptide able to efficiently secrete a protein from a cell. Exemplary signal peptides include any described in Table 12.

TABLE 12

Exemplary Signal Peptides

| SEQ ID NO | Signal Peptide | Peptide Sequence |
|---|---|---|
| SEQ ID NO: 221 | HSA signal peptide | MKWVTFISLLFLFSSAYS |
| SEQ ID NO: 222 | 1g kappa light chain | MDMRAPAGIFGFLLVLFPGYRS |
| SEQ ID NO: 223 | human azurocidin preprotein signal sequence | MTRLTVLALLAGLLASSRA |
| SEQ ID NO: 224 | IgG heavy chain signal peptide | MELGLSWIFLLAILKGVQC |
| SEQ ID NO: 225 | IgG heavy chain signal peptide | MELGLRWVFLVAILEGVQC |
| SEQ ID NO: 226 | IgG heavy chain signal peptide | MKHLWFFLLLVAAPRWVLS |
| SEQ ID NO: 227 | IgG heavy chain signal peptide | MDWTWRILFLVAAATGAHS |
| SEQ ID NO: 228 | IgG heavy chain signal peptide | MDWTWRFLFVVAAATGVQS |
| SEQ ID NO: 229 | IgG heavy chain signal peptide | MEFGLSWLFLVAILKGVQC |
| SEQ ID NO: 230 | IgG heavy chain signal peptide | MEFGLSWVFLVALFRGVQC |
| SEQ ID NO: 231 | IgG heavy chain signal peptide | MDLLHKNMKHLWFFLLLVAAPRWVLS |
| SEQ ID NO: 232 | IgG Kappa light chain signal sequences: | MDMRVPAQLLGLLLLWLSGARC |
| SEQ ID NO: 233 | IgG Kappa light chain signal sequences: | MKYLLPTAAAGLLLLAAQPAMA |
| SEQ ID NO: 234 | Gaussia luciferase | MGVKVLFALICIAVAEA |
| SEQ ID NO: 235 | Human albumin | MKWVTFISLLFLFSSAYS |
| SEQ ID NO: 236 | Human chymotrypsinogen | MAFLWLLSCWALLGTTFG |
| SEQ ID NO: 237 | Human interleukin-2 | MQLLSCIALILALV |
| SEQ ID NO: 238 | Human trypsinogen-2 | MNLLLILTFVAAAVA |

In some embodiments of a secretable immunomodulatory protein, the immunomodulatory protein comprises a signal peptide when expressed, and the signal peptide (or a portion thereof) is cleaved from the immunomodulatory protein upon secretion from a cell.

B. Cells and Engineering Cells

Provided herein are engineered cells expressing any of the provided immunomodulatory polypeptides. In some embodiments, the engineered cells express and are capable of or are able to secrete the immunomodulatory protein from the cells under conditions suitable for secretion of the protein. In some embodiments, the engineered cells can be administered to the subject, such as for treating a disease or condition, including any as described herein.

In some embodiments, the immunomodulatory protein is expressed on or in a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, regulatory T cells, T helper cells, cytotoxic T-cells (alternatively, cytotoxic T lymphocytes or CTLs), natural killer T-cells, memory T-cells, or gamma delta T-cells. In some embodiments, the engineered T cells are CD4+ or CD8+. In some aspects the engineered T cells can be activated T cells. In some embodiments, the engineered T cells are regulatory T cells (Treg).

In some embodiments, the engineered cell, e.g. T cell, can further express a chimeric antigen receptor (CAR) or engineered T cell receptor (TCR). In some aspects, the CAR or TCR are specific for an antigen expressed by a cell or tissue associated with a disease or condition, such as an inflammatory tissue or cell. In some cases, binding of a CAR or TCR to the antigen can guide the engineered cell to the cell or tissue specific antigen and locally deliver the provided immunomodulatory protein, e.g. secretable immunomodulatory protein.

In some embodiments, the immunomodulatory polypeptides, such as secretable immunomodulatory proteins, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In some embodiments, a nucleic acid encoding the immunomodulatory protein is sub-cloned into a viral vector, such as a retroviral vector, which allows expression in the host mammalian cell. The expression vector can be introduced into a mammalian host cell and, under host cell culture conditions, the immunomodulatory protein is expressed, such as is secreted, from the cell.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule. T-cells that express the immunomodulatory polypeptide can be enriched through sorting with anti-epitope tag antibodies or enriched for high or low expression depending on the application. A composition containing the engineered cell can be assessed or monitored for secretion of the immunomodulatory protein, such as by detection in the media or supernatant usinng an anti-eptitope tag.

C. Infectious Agent

Provided herein are infectious agents, e.g., virus or bacteria, containing nucleic acid sequences that encode any of the multi-domain immunomodulatory proteins, including secretable proteins described herein, and by virtue of contact and/or infection of a cell, the cell expresses, and, in some cases secretes, the multi-domain immunomodulatory proteins. In some embodiments, the infectious agent can be administered to the subject, such as for treating a disease or condition, including any as described herein. In some embodiments, the infectious agent can be contacted with cells from the subject ex vivo.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the multi-domain immunomodulatory proteins, including secretable proteins described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the cells in the subject that are targeted by the infectious agent include an immune cell and/or an antigen-presenting cell (APC). In some embodiments, the infectious agent delivers the nucleic acids encoding the variant polypeptides, such as multi-domain immunomodulatory proteins, including secretable immunomodulatory proteins, to an appropriate cell (for example, a T cell that recognizes peptide/MHC on an APC such as a Treg cell) or tissue (e.g., lymphoid tissue) that modulates an immune response and/or a specific cell-mediated immune response. In some embodiments, the infectious agent targets a T cell, such as a regulatory T cell (Treg). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. In some embodiments, the additional gene product can be a therapeutic gene product that can result in death of the target cell (e.g., immune cell) or gene products that can inhibit or suppress or regulate an immune response (e.g., cytokine). Exemplary gene products also include an immunomodulatory molecule, an immune checkpoint activator, an antibody, a cytokine, a growth factor, an antigen, a cytotoxic gene product, a pro-apoptotic gene product, an anti-apoptotic gene product, a cell matrix degradative gene, and other genes described herein or known to one of skill in the art.

1. Viruses

In some embodiments, the infectious agent is a virus. In some embodiments, the infectious agent is a virus that targets particular cells, e.g., immune cells. In some embodiments, the infectious agent targets an immune cell or a T cell.

In some embodiments, the virus is an adenovirus (Ad); adeno-associated virus (AAV); herpes simplex virus (HSV); retroviral vector, such as Moloney murine leukemia virus (MMLV); hybrid retrovirus (e.g., containing various retroviral LTRs on their 5' end, optimal for production of high-titer viral stocks, and spleen focus-forming virus (SFFV) LTR on 3' end); lentiviral vector, such as human immunodeficiency virus (HIV-1), HIV-2, bovine lentivirus, feline lentivirus, or simian lentivirus; self-inactivating vector (SIV).

In some embodiments, the infectious agent is a modified herpes simplex virus. In some embodiments, the infectious agent is a modified version of Talimogene laherparepvec (also known as T-Vec, Imlygic or OncoVex GM-CSF), that is modified to contain nucleic acids encoding any of the variant immunomodulatory polypeptides described herein, such as multi-domain immunomodulatory proteins described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, wherein the infectious agent is a virus, the tropism of viral particles is modified so that only cells expressing particular surface markers are transduced.

2. Bacteria

In some embodiments, the infectious agent is a bacterium. For example, in some embodiments, the bacteria can deliver nucleic acids encoding any of the multi-domain immunomodulatory proteins described herein to a target cell in the subject, such as an immune cell. In some embodiments, the bacterium can be preferentially targeted to a specific environment within a subject, such as an inflammatory environment, for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., certain immune cells or tissue types). In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., immune cells. In some embodiments, the bacterium can contain and/or release nucleic acid sequences and/or gene products in the cytoplasm of the target cells, thereby killing the target cell, e.g., immune cell. In some embodiments, the infectious agent is bacterium that can replicate specifically in a particular environment in the subject, e.g., inflammatory environment. For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the inflammatory environment, can act as chemoattractants to attract the bacterium to the environment. In some embodiments, the bacterium can express and/or secrete the immunomodulatory proteins described herein in the environment, e.g., inflammatory environment.

In some embodiments, the infectious agent is a bacterium that is a *Listeria* sp., a *Bifidobacterium* sp., an *Escherichia* sp., a *Clostridium* sp., a *Salmonella* sp., a *Shigella* sp., a *Vibrio* sp. or a *Yersinia* sp. In some embodiments, the bacterium is selected from among one or more of *Listeria monocytogenes, Salmonella typhimurium, Salmonella choleraesuis, Escherichia coli, Vibrio cholera, Clostridium perfringens, Clostridium butyricum, Clostridium novyi, Clostridium acetobutylicum, Bifidobacterium infantis, Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009) Molecular Therapy 17(5):767-777; Baban et al. (2010) Bioengineered Bugs 1:6, 385-394; Patyar et al. (2010) J Biomed Sci 17:21; Tangney et al. (2010) Bioengineered Bugs 1:4, 284-287; van Pijkeren et al. (2010) Hum Gene Ther. 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

VI. PHARMACEUTICAL COMPOSITIONS

Provided herein are compositions containing any of the provided immunomodulatory proteins, engineered cells or infectious agents described herein. The pharmaceutical composition can further comprise a pharmaceutically acceptable excipient. For example, the pharmaceutical composition can contain one or more excipients for modifying, maintaining or preserving, for example, the pH, osmolarity, viscosity, clarity, color, isotonicity, odor, sterility, stability, rate of dissolution or release, adsorption, or penetration of the composition. In some aspects, a skilled artisan understands that a pharmaceutical composition containing cells may differ from a pharmaceutical composition containing a protein.

In some embodiments, the pharmaceutical composition is a solid, such as a powder, capsule, or tablet. For example, the components of the pharmaceutical composition can be lyophilized. In some embodiments, the solid pharmaceutical composition is reconstituted or dissolved in a liquid prior to administration.

In some embodiments, the pharmaceutical composition is a liquid, for example multi-domain immunomodulatory proteins dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrystalline cellulose, sucrose, lactose, glucose, mannitol, sorbitol, maltol, pregelatinized starch, corn starch, or potato starch. Examples of pharmaceutically-acceptable binders include polyvinylpyrrolidone, starch, lactose, xylitol, sorbitol, maltitol, gelatin, sucrose, polyethylene glycol, methyl cellulose, or cellulose. Examples of pharmaceutically-acceptable coatings include hydroxypropyl methylcellulose (HPMC), shellac, corn protein zein, or gelatin. Examples of pharmaceutically-acceptable disintegrants include polyvinylpyrrolidone, carboxymethyl cellulose, or sodium starch glycolate. Examples of pharmaceutically-acceptable lubricants include polyethylene glycol, magnesium stearate, or stearic acid. Examples of pharmaceutically-acceptable preservatives include methyl parabens, ethyl parabens, propyl paraben, benzoic acid, or sorbic acid. Examples of pharmaceutically-acceptable sweetening agents include sucrose, saccharine, aspartame, or sorbitol. Examples of pharmaceutically-acceptable buffering agents include carbonates, citrates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral administration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical compositions containing the transmembrane immunomodulatory proteins, including engineered cells expressing such transmembrane immunomodulatory proteins. In some embodiments, the pharmaceutical compositions and formulations include one or more optional pharmaceutically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about $1\times10^5$ and about $1\times10^{12}$ plaque-forming units (pfu), $1\times10^6$ and $1\times10^{10}$ pfu, or $1\times10^7$ and $1\times10^{10}$ pfu, each inclusive, such as at least or at least about or at about $1\times10^6$, $1\times10^7$, $1\times10^8$, $1\times10^9$, $2\times10^9$, $3\times10^9$, $4\times10^9$, $5\times10^9$ pfu or about $1\times10^{10}$ pfu. In some embodiments, the pharmaceutical composition can contain a virus concentration of from or from about $10^5$ to about $10^{10}$ pfu/mL, for example, $5\times10^6$ to $5\times10^9$ or $1\times10^7$ to $1\times10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1\times10^3$ and about $1\times10^9$ colony-forming units (cfu), $1\times10^4$ and $1\times10^9$ cfu, or $1\times10^5$ and $1\times10^7$ cfu, each inclusive, such as at least or at least about or at about $1\times10^4$, $1\times10^5$, $1\times10^6$, $1\times10$, $1\times10^8$ or $1\times10^9$ cfu. In some embodiments, the pharmaceutical composition can contain a bacterial concentration of from or from about $10^3$ to about $10^8$ cfu/mL, for example, $5\times10^5$ to $5\times10^7$ or $1\times10^6$ to $1\times10^7$ cfu/mL, such as at least or at least about or at about $10^5$ cfu/mL, $10^6$ cfu/mL, $10^7$ cfu/mL or $10^8$ cfu/mL Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-α, IFN-γ, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject through any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 μg of protein per kg subject body mass or more (such as about 2 μg of protein per kg subject body mass or more, about 5 μg of protein per kg subject body mass or more, about 10 μg of protein per kg subject body mass or more, about 25 μg of protein per kg subject body mass or more, about 50 μg of protein per kg subject body mass or more, about 100 μg of protein per kg subject body mass or more, about 250 μg of protein per kg subject body mass or more, about 500 μg of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g. T cells, as described herein may be administered at a dosage of $10^4$ to $10^9$ cells/kg body weight, such as $10^5$ to $10^6$ cells/kg body weight, including all integer values within those ranges. Engineered cell compositions, such as T cell compositions, may also be administered multiple times at these dosages. The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional, profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or self-polypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VII. METHODS OF ASSESSING ACTIVITY AND IMMUNE MODULATION OF IMMUNOMODULATORY PROTEINS

In some embodiments, the multi-domain immunomodulatory proteins provided herein exhibit immunomodulatory activity to modulate T cell activation or response. In some embodiments, T cell activation or response is reduced, decreased or attenuated. Among T cell responses that can be modulated by provided immunomodulatory proteins include one or more of cell cycle inhibition, reduced cell survival, reduced cell proliferation, reduced cytokine production (e.g. IFN-gamma or IL-2), or reduced T-cell cytotoxicity. In some embodiments, the reduced activity is observed in vitro in a primary T cell activation assays, such as in a Jurkat reporter assay, SEB assay or mixed lymphocyte reaction (MLR) assay. In some embodiments, the reduced or decreased activity is observed in vivo upon administration to a subject, such as a human or mammalian subject.

In some embodiments, the activity is reduced by at least 10%, 20%, 30%, 40%, 50%, 60%, 70%, 80%, 90%, or 100% compared to the activity in the same assay in the absence of the immunomodulatory protein. In some embodiments, the activity is reduced by at least 10%, 20%, 30%, 40%, 50%, 60%, 70%, 80%, 90%, or 100% compared to the activity in the same assay presence of a control in which the control is a protein that is known or suspected not to modulate T cell activity, e.g. an Fc only control. In some embodiments, the activity is reduced to a level that is greater than the reduction observed by a reference immunomodulatory protein containing only the ARBM or containing only the IRBM, such as is reduced by greater than or greater than about 1.2-fold, 1.3-fold, 1.4-fold, 1.5-fold, 2.0-fold, 3.0-fold, 4.0-fold 5.0-fold or more compared to the reference immunomodulatory protein.

In some embodiments, multi-domain immunomodulatory proteins modulate IFN-gamma expression or production or IL-2 expression of production in a T cell assay relative to a control protein or reference immunomodulatory protein (e.g. containing only an ARBM or only an IRBM or containing a wild-type or unmodified IgSF domain).

In some ses, modulation of IFN-gamma or IL-2 expression or production is a decrease in IFN-gamma or IL-2 expression or production relative to the control or reference protein.

In some aspects, assays typically employed in connection with assaying modulation of immune activity of the provided immunomodulatory proteins include assays involving co-culture of T cells and antigen presenting cells. Such assays are well-known in the art and include, for example, the MLR (mixed lymphocyte reaction) assays measuring interferon-gamma or IL-2 cytokine levels in culture supernatants (Wang et al., Cancer Immunol Res. 2014 September: 2(9):846-56). In such assays, immunomodulatory proteins can in some embodiments decrease IFN-gamma (interferon-gamma) or IL-2 expression or production in a primary T-cell assay relative to a control or reference protein.

In some embodiments, in assaying for the ability of a provided immunomodulatory protein to modulate, e.g. decrease, IFN-gamma or IL-2 expression or production a T cell reporter assay can be used. In some embodiments, the T cell is a Jurkat T cell line or is derived from Jurkat T cell lines. In reporter assays, the reporter cell line (e.g. Jurkat reporter cell) also is generated to overexpress an activating receptor, such as a costimulatory receptor, that is the binding partner of the immunomodulatory protein. In some embodiments, the reporter cell line is generated to overexpress an inhibitory receptor that is the binding partner of the immunomodulatory protein. For example, in the case of an immunomodulatory protein, the reporter cell line (e.g. Jurkat reporter cell) can be generated to overexpress PD-1. In some embodiments, the reporter T cells also contains a reporter construct containing an inducible promoter responsive to T cell activation operably linked to a reporter. In some embodiments, the reporter is a fluorescent or luminescent reporter. In some embodiments, the reporter is luciferase. In some embodiments, the promoter is responsive to CD3 signaling. In some embodiments, the promoter is an NFAT promoter. In some embodiments, the promoter is responsive to costimulatory signaling, e.g. CD28 costimulatory signaling. In some embodiments, the promoter is an IL-2 promoter.

In aspects of a reporter assay, a reporter cell line is stimulated, such as by co-incubation with antigen presenting cells (APCs), including APCs expressing one or more ligands of an activating receptor, e.g. costimulatory receptor, e.g. ICOSL, CD80, CD86, PD-L1, PD-L2, CD155 or CD112. In some embodiments, the APCs are artificial APCs. Artificial APCs are well known to a skilled artisan. In some embodiments, artificial APCs are derived from one or more mammalian cell line, such as K562, CHO or 293 cells. In some embodiments, the aAPCs can also express an anti-CD3 antibody (e.g. OKT3).

In some embodiments, the Jurkat reporter cells are co-incubated with artificial APCs in the presence of the immunomodulatory protein. In some embodiments, reporter expression is monitored, such as by determining the luminescence or fluorescence of the cells. In some embodiments, normal interactions between Jurkat cells and APCs, e.g. via activating receptor and their ligand, result in an enhancement of or increase in the reporter signal, such as compared to control, e.g. reporter expression by co-incubation of control T cells and APCs in which the activating receptor and ligand interaction is not present. In some embodiments, a provided immunomodulatory protein provided herein attenuates or decreases the reporter signal, thereby resulting in a decrease in the reporter signal compared to the absence of the immunomodulatory protein.

Use of proper controls is known to those of skill in the art, however, in the aforementioned embodiments, a control typically involves use of a reference protein containing one of the proteins of the immunomodulatory protein. In some embodiments, the control is of the same form or corresponding form as the immunomodulatory protein. For example, if the immunomodulatory protein is a soluble form containing one or more ARBM and IRBM fused to an Fc protein, than the control is a soluble form containing the ARBM or IRBM fused to the Fc protein. Irrespective of whether the binding affinity and/or selectivity to the inhibitory or activating receptor is increased or decreased, an immunomodulatory protein in some embodiments will decrease a T cell response, e.g. IFN-gamma or IL-2 expression or production, in a T-cell assay relative to a control or reference protein. In some embodiments, a provided immunomodulatory protein decreases a T cell response, e.g. IFN-gamma or IL-2 expression or production (i.e., protein expression), relative to a control or reference protein by at least: 5%, 10%, 20%, 30%, 40%, 50%, 60%, 70%, 80%, 90%, or higher.

In some cases, activity of a multi-domain immunomodulatory protein as provided can be assessed using an appropriate animal model. In some embodiments, the animal model is a model of autoimmune disease. Animal models of autoimmune activities include spontaneous animal models, such as spontaneous mouse models for autoimmune diseases, generated through the crossing of animal (e.g., mouse) strains that have genetic susceptibility genes or loci followed by careful monitoring of the animals for the development of disease phenotype. Exemplary spontaneous animal models include the nonobese diabetic (NOD) mouse model, which spontaneously develops type 1 diabetes mellitus (T1D)-like phenotypes, and the NZB/W F1 mouse model, which spontaneously develops systemic lupus erythematosus (SLE)-like phenotypes. Another exemplary animal model of autoimmune disease includes the experimental autoimmune encephalomyelitis (EAE) mouse model, generated by autoantigen injection for the study of multiple sclerosis (MS). Exemplary rheumatoid arthritis (RA) models include human T-cell leukemia virus type I (HTLV-I) transgenic mouse models and IL-1 receptor antagonist (IL-1Ra) deficient (KO) mouse models. Concanavalin A (Con A)-induced hepatitis in the mouse is an exemplary model for autoimmune hepatitis (Tiegs et al., 1992, JCI, Mizuhara H., JEM, 1994, Toyabe S, JI, 1997). Other exemplary animal models include graft versus host-disease (GVHD) mouse model, syngeneic transplant mouse models, and bone marrow transplant models. Animal models are widely used to study pathology and treatment of autoimmune disease and can be used to assess the use, dosage, and efficacy of the multi-domain immunomodulatory proteins provided herein.

VIII. THERAPEUTIC APPLICATIONS

Provided herein are compositions and methods relating to the provided immunomodulatory proteins, engineered cells and infectious agents described herein for use in modulating immunological activity of a mammalian cell. The compositions can be used in associated methods to, for example, modulate immunological activity in an immunotherapy approach to the treatment of a disease. For example, in some embodiments the pharmaceutical composition is used to treat inflammatory or autoimmune disorders, cancer, organ transplantation, viral infections, and/or bacterial infections in a mammal. The pharmaceutical composition can modulate (e.g. increase or decrease) an immune response to treat the disease. In particular embodiments, the provided multi-domain immunomodulatory proteins and pharmaceutical compositions thereof can be used for the treatment of inflammatory or autoimmune disorders.

In some embodiments, the method comprises contacting a multi-domain immunomodulatory protein (which may be secreted by an engineered cell) provided herein with a mammalian cell under conditions that are permissive to specific binding of the protein and modulation of the immunological activity of the mammalian cell. The methods can be employed ex vivo or in vivo.

Such methods and uses include therapeutic methods and uses, for example, involving administration of the molecules or engineered cells, or compositions containing the same, to a subject having a disease, condition, or disorder. In some cases, such as for multi-domain immunomodulatory proteins that reduce or decrease an immune response or T cell response, the disease or disorder is an autoimmune or inflammatory disease or disorder. In some cases, such as for multi-domain immunomodulatory proteins that increase an immune response or T cell response, the disease or disorder is a tumor or cancer. In some embodiments, the multi-domain immunomodulatory protein or pharmaceutical composition thereof is administered in an effective amount to effect treatment of the disease or disorder. Uses include uses of multi-domain immunomodulatory proteins or pharmaceutical compositions thereof in such methods and treatments, and in the preparation of a medicament in order to carry out such therapeutic methods. In some embodiments, the methods are carried out by administering a multi-domain immunomodulatory protein or compositions comprising the same, to the subject having or suspected of having the disease or condition. In some embodiments, the methods thereby treat the disease or condition or disorder in the subject.

In some embodiments, the method of modulating immunological activity is achieved by administering an immunomodulatory protein to a subject. In other cases, modulating an immunological activity is achieved by administering an engineered cell expressing the immunomodulatory protein, including expression and secretion of an immunomodulatory protein of the present invention by an immune cell, such as a lymphocyte (e.g., a T-cell or TIL) or NK cell engineered to express and secrete the immunomodulatory protein. In such embodiments, the method can conducted by adoptive cell transfer of engineered cells expressing and secreting the immunomodulatory protein (e.g., a T-cell) are infused back into the patient. In some embodiments, modulating an immunological activity is achieved by administering an infectious agent capable of infecting a cell in a subject, such as to express and secrete the immunomodulatory protein in the subject.

The pharmaceutical compositions described herein can be used in a variety of therapeutic applications, such as the treatment of a disease. For example, in some embodiments the pharmaceutical composition is used to treat inflammatory or autoimmune disorders, organ transplantation, viral infections, and/or bacterial infections in a mammal. The pharmaceutical composition can modulate an immune response to treat the disease. In some embodiments, the pharmaceutical composition suppresses an immune response, which can be useful in the treatment of inflammatory or autoimmune disorders, or organ transplantation.

The provided methods are believed to have utility in a variety of applications, including, but not limited to, e.g., in prophylactic or therapeutic methods for treating a variety of immune system diseases or conditions in a mammal in which modulation or regulation of the immune system and immune system responses is beneficial. For example, suppressing an immune response can be beneficial in prophylactic and/or therapeutic methods for inhibiting rejection of a tissue, cell, or organ transplant from a donor by a recipient. In a therapeutic context, the mammalian subject is typically one with an immune system disease or condition, and administration is conducted to prevent further progression of the disease or condition.

In some embodiments, the provided compositions can attenuate an immune response, such as, for example, where the immunomodulatory protein comprises an affinity modified IgSF domain of an inhibitory ligand. In some embodiments, the compositions can be used to treat an autoimmune disease. In some embodiments, the administration of a therapeutic composition of the invention to a subject suffering from an immune system disease (e.g., autoimmune disease) can result in suppression or inhibition of such immune system attack or biological responses associated therewith. By suppressing this immune system attack on healthy body tissues, the resulting physical symptoms (e.g., pain, joint inflammation, joint swelling or tenderness) resulting from or associated with such attack on healthy tissues can be decreased or alleviated, and the biological and physical damage resulting from or associated with the immune system attack can be decreased, retarded, or stopped. In a prophylactic context, the subject may be one with, susceptible to, or believed to present an immune system disease, disorder or condition, and administration is typically conducted to prevent progression of the disease, disorder or condition, inhibit or alleviate symptoms, signs, or biological responses associated therewith, prevent bodily damage potentially resulting therefrom, and/or maintain or improve the subject's physical functioning.

In some embodiments, the inflammatory or autoimmune disorder is antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

The immune system disease or disorder of the patient may be or involve, e.g., but is not limited to, Addison's Disease, Allergy, Alopecia Areata, Alzheimer's, Antineutrophil cytoplasmic antibodies (ANCA)-associated vasculitis, Ankylosing Spondylitis, Antiphospholipid Syndrome (Hughes Syndrome), arthritis, Asthma, Atherosclerosis, Atherosclerotic plaque, autoimmune disease (e.g., lupus, RA, MS, Graves' disease, etc.), Autoimmune Hemolytic Anemia, Autoimmune Hepatitis, Autoimmune inner ear disease, Autoimmune Lymphoproliferative syndrome, Autoimmune Myocarditis, Autoimmune Oophoritis, Autoimmune Orchitis, Azoospermia, Behcet's Disease, Berger's Disease, Bullous Pemphigoid, Cardiomyopathy, Cardiovascular disease, Celiac Sprue/Coeliac disease, Chronic Fatigue Immune Dysfunction Syndrome (CFIDS), Chronic idiopathic polyneuritis, Chronic Inflammatory Demyelinating, Polyradicalneuropathy (CIPD), Chronic relapsing polyneuropathy (Guillain-Barré syndrome), Churg-Strauss Syndrome (CSS), Cicatricial Pemphigoid, Cold Agglutinin Disease (CAD), COPD, CREST syndrome, Crohn's disease, Dermatitis, Herpetiformus, Dermatomyositis, diabetes, Discoid Lupus, Eczema, Epidermolysis bullosa acquisita, Essential Mixed Cryoglobulinemia, Evan's Syndrome, Exopthalmos, Fibromyalgia, Goodpasture's Syndrome, graft-related disease or disorder, Graves' Disease, GVHD, Hashimoto's Thyroiditis, Idiopathic Pulmonary Fibrosis, Idiopathic Thrombocytopenia Purpura (ITP), IgA Nephropathy, immunoproliferative disease or disorder (e.g., psoriasis), Inflammatory bowel disease (IBD), Insulin Dependent Diabetes Mellitus (IDDM), Interstitial lung disease, juvenile diabetes, Juvenile Arthritis, juvenile idiopathic arthritis (JIA), Kawasaki's Disease, Lambert-Eaton Myasthenic Syndrome, Lichen Planus, lupus, Lupus Nephritis, Lymphoscytic Lypophisitis, Ménière's Disease, Miller Fish Syndrome/acute disseminated encephalomyeloradiculopathy, Mixed Connective Tissue Disease, Multiple Sclerosis (MS), muscular rheumatism, Myalgic encephalomyelitis (ME), Myasthenia Gravis, Ocular Inflammation, *Pemphigus Foliaceus, Pemphigus* Vulgaris, Pernicious Anaemia, Polyarteritis Nodosa, Polychondritis, Polyglandular Syndromes (Whitaker's syndrome), Polymyalgia Rheumatica, Polymyositis, Primary Agammaglobulinemia, Primary Biliary Cirrhosis/Autoimmune cholangiopathy, Psoriasis, Psoriatic arthritis, Raynaud's Phenomenon, Reiter's Syndrome/Reactive arthritis, Restenosis, Rheumatic Fever, rheumatic disease, Rheumatoid Arthritis, Sarcoidosis, Schmidt's syndrome, Scleroderma, Sjörgen's Syndrome, Solid-organ transplant rejection (kidney, heart, liver, lung, etc.), Stiff-Man Syndrome, Systemic Lupus Erythematosus (SLE), systemic scleroderma, Takayasu Arteritis, Temporal Arteritis/Giant Cell Arteritis, Thyroiditis, Type 1 diabetes, Type 2 diabetes, Ulcerative colitis, Uveitis, Vasculitis, Vitiligo, Wegener's Granulomatosis, and preventing or suppressing an immune response associated with rejection of a donor tissue, cell, graft, or organ transplant by a recipient subject. Graft-related diseases or disorders include graft versus host disease (GVDH), such as associated with bone marrow transplantation, and immune disorders resulting from or associated with rejection of organ, tissue, or cell graft transplantation (e.g., tissue or cell allografts or xenografts), including, e.g., grafts of skin, muscle, neurons, islets, organs, parenchymal cells of the liver, etc. With regard to a donor tissue, cell, graft or solid organ transplant in a recipient subject, it is believed that a therapeutic composition of the invention disclosed herein may be effective in preventing acute rejection of such transplant in the recipient and/or for long-term maintenance therapy to prevent rejection of such transplant in the recipient (e.g., inhibiting rejection of insulin-producing islet cell transplant from a donor in the subject recipient suffering from diabetes).

The inflammatory and autoimmune disorders that can be treated by the pharmaceutical compositions and the treatment methods described herein include, but are not limited to, Addison's Disease, allergies, alopecia areata, Alzheimer's, antineutrophil cytoplasmic antibodies (ANCA)-associated vasculitis, ankylosing spondylitis, antiphospholipid syndrome (Hughes Syndrome), asthma, atherosclerosis, rheumatoid arthritis, autoimmune hemolytic anemia, autoimmune hepatitis, autoimmune inner ear disease, autoimmune lymphoproliferative syndrome, autoimmune myocarditis, autoimmune oophoritis, autoimmune orchitis, azoospermia, Behcet's Disease, Berger's Disease, bullous pemphigoid, cardiomyopathy, cardiovascular disease, celiac Sprue/coeliac disease, chronic fatigue immune dysfunction syndrome (CFIDS), chronic idiopathic polyneuritis, chronic inflammatory demyelinating, polyradicalneuropathy (CIDP), chronic relapsing polyneuropathy (Guillain-Barre syndrome), Churg-Strauss Syndrome (CSS), cicatricial pemphigoid, cold agglutinin disease (CAD), COPD (chronic obstructive pulmonary disease), CREST syndrome, Crohn's disease, dermatitis, herpetiformus, dermatomyositis, diabetes, discoid lupus, eczema, epidermolysis bullosa acquisita, essential mixed cryoglobulinemia, Evan's Syndrome, exopthalmos, fibromyalgia, Goodpasture's Syndrome, Graves' Disease, Hashimoto's thyroiditis, idiopathic pulmonary fibrosis, idiopathic thrombocytopenia purpura (ITP), IgA nephropathy, immunoproliferative disease or disorder, inflammatory bowel disease (IBD), interstitial lung disease, juvenile arthritis, juvenile idiopathic arthritis (JIA), Kawasaki's Disease, Lambert-Eaton Myasthenic Syndrome, lichen planus, lupus nephritis, lymphocytic hypophysitis, Ménière's Disease, Miller Fish Syndrome/acute disseminated encephalomyeloradiculopathy, mixed connective tissue disease, multiple sclerosis (MS), muscular rheumatism, myalgic encephalomyelitis (ME), myasthenia gravis, ocular inflammation, *Pemphigus foliaceus, Pemphigus vulgaris*, pernicious anaemia, polyarteritis nodosa, polychondritis, polyglandular syndromes (Whitaker's syndrome), polymyalgia rheumatica, polymyositis, primary agammaglobulinemia, primary biliary cirrhosis/autoimmune cholangiopathy, psoriasis, psoriatic arthritis, Raynaud's Phenomenon, Reiter's Syndrome/reactive arthritis, restenosis, rheumatic fever, rheumatic disease, sarcoidosis, Schmidt's syndrome, scleroderma, Sjörgen's Syndrome, stiff-man syndrome, systemic lupus erythematosus (SLE), systemic scleroderma, Takayasu arteritis, temporal arteritis/giant cell arteritis, thyroiditis, Type 1 diabetes, ulcerative colitis, uveitis, vasculitis, vitiligo, interstitial bowel disease or Wegener's Granulomatosis. In some embodiments, the inflammatory or autoimmune disorder is selected from interstitial bowel disease, transplant, Crohn's disease, ulcerative colitis, multiple sclerosis, asthma, rheumatoid arthritis, and psoriasis.

In some embodiments, the disease or condition is one that is a result of PDL1 dysregulation. In some embodiments, the disease or condition is a vasculitis that is a giant cell arteritis (GCA).

In some embodiments, the pharmaceutical composition is administered to modulate an autoimmune condition. For example, suppressing an immune response can be beneficial in methods for inhibiting rejection of a tissue, cell, or organ transplant from a donor by a recipient. Accordingly, in some embodiments, the pharmaceutical compositions described herein are used to limit or prevent graft-related or transplant related diseases or disorders, such as graft versus host disease (GVHD). In some embodiments, the pharmaceutical compositions are used to suppress autoimmune rejection of transplanted or grafted bone marrow, organs, skin, muscle, neurons, islets, or parenchymal cells.

In some embodiments, a therapeutic amount of the pharmaceutical composition is administered. Typically, precise amount of the compositions of the present invention to be administered can be determined by a physician with consideration of individual differences in age, weight, extent of infection, and condition of the patient (subject). The optimal dosage and treatment regime for a particular patient can readily be determined by one skilled in the art of medicine by monitoring the patient for signs of disease and adjusting the treatment accordingly.

The administration of the subject compositions may be carried out in any convenient manner, including by aerosol inhalation, injection, ingestion, transfusion, implantation or transplantation. The compositions described herein may be administered to a patient subcutaneously, intradermally, intratumorally, intranodally, intramedullary, intramuscularly, by intravenous (i.v.) injection, or intraperitoneally. In one embodiment, the therapeutic composition is administered to a patient by intradermal or subcutaneous injection. In another embodiment, the therapeutic composition is administered by i.v. injection.

Cell compositions engineered to express and secrete immunomodulatory proteins of the present invention and associated methods can be used in immunotherapy applications. In some embodiments, cells isolated from a mammal, such as a mouse or human, can be engineered to express and secrete an immunomodulatory protein. In some embodiments, the mammalian cell serving as a host cell for expression and secretion or surface expression of an immunomodulatory protein is a lymphocyte such as a tumor infiltrating lymphocyte (TIL), a natural killer (NK) cell, or a T-cell such as a CD8+ cytotoxic T lymphocyte or a CD4+ helper T lymphocyte. In aspects of the provided method, the engineered cells are contacted, generally under physiological conditions, with a mammalian cell in which modulation of immunological activity is desired. For example, the mammalian cell can be a murine or human cell such as with immune cells, such as antigen presenting cell and/or T cell. In some embodiments, the engineered cells are autologous cells. In other embodiments, the cells are allogeneic. Cells can be contacted in vivo or ex vivo. In some embodiments, the engineered cells are administered to the subject, such as by infusion. Thus, composition and methods can be used in adoptive cell transfer immunotherapy. In some embodiments, the cells are autologous cells.

It can generally be stated that a pharmaceutical composition comprising engineered cells, e.g. T cells, as described herein may be administered at a dosage of $10^4$ to $10^9$ cells/kg body weight, such as $10^5$ to $10^6$ cells/kg body weight, including all integer values within those ranges. Engineered cell compositions, such as T cell compositions, may be administered multiple times at these dosages. The cells can be administered by using infusion techniques that are commonly known in immunotherapy (see, e.g., Rosenberg et al, New Eng. J. of Med. 319: 1676, 1988). In some cases, the cell compositions may be injected directly into a site of infection.

In some embodiments, the method is conducted by administration of a pharmaceutical compositions containing infectious agent containing a nucleic acid molecule encoding the immunomodulatory protein as a secretable immunomodulatory protein. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about $1\times10^5$ and about $1\times10^{12}$ plaque-forming units (pfu), $1\times10^6$ and $1\times10^{10}$ pfu, or $1\times10^7$ and $1\times10^{10}$ pfu, each inclusive, such as at least or at least about or at about $1\times10^6$, $1\times10^7$, $1\times10^8$, $1\times10^9$, $2\times10^9$, $3\times10^9$, $4\times10^9$, $5\times10^9$ pfu or about $1\times10^{10}$ pfu. In some embodiments, the pharmaceutical composition can contain a virus concentration of from or from about $10^5$ to about $10^{10}$ pfu/mL, for example, $5\times10^6$ to $5\times10^9$ or $1\times10^7$ to $1\times10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1\times10^3$ and about $1\times10^9$ colony-forming units (cfu), $1\times10^4$ and $1\times10^9$ cfu, or $1\times10^5$ and $1\times10^7$ cfu, each inclusive, such as at least or at least about or at about $1\times10^4$, $1\times10^5$, $1\times10^6$, $1\times10^7$, $1\times10^8$ or $1\times10^9$ cfu. In some embodiments, the pharmaceutical composition can contain a bacterial concentration of from or from about $10^3$ to about $10^8$ cfu/mL, for example, $5\times10^5$ to $5\times10^7$ or $1\times10^6$ to $1\times10^7$ cfu/mL, such as at least or at least about or at about $10^5$ cfu/mL, $10^6$ cfu/mL, $10^7$ cfu/mL or $10^8$ cfu/mL.

In some embodiments, the pharmaceutical composition is administered as a monotherapy (i.e., as a single agent) or as a combination therapy (i.e., in combination with one or more additional immunosuppressant agents). In some embodiments, the additional agent is a glucocorticoid (e.g., prednisone, dexamethasone, and hydrocortisone), cytostatic agent, such as a cytostatic agent that affect proliferation of T cells and/or B cells (e.g., purine analogs, alkylating agents, or antimetabolites), an antibody (e.g., anti-CD20, anti-CD25 or anti-CD3 monoclonal antibodies), cyclosporine, tacrolimus, sirolimus, everolimus, an interferon, an opiod, a TNF binding protein, mycophenolate, small biological agent, such as fingolimod or myriocin, cytokine, such as interferon beta-1a, an integrin agonist, or an integrin antagonist.

IX. ARTICLES OF MANUFACTURE AND KITS

Also provided herein are articles of manufacture that comprise the pharmaceutical compositions described herein in suitable packaging. Suitable packaging for compositions (such as ophthalmic compositions) described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

X. EXAMPLES

The following examples are included for illustrative purposes only and are not intended to limit the scope of the invention.

Example 1

Generation of Multi-Domain Immunomodulatory Proteins Containing Activating and Inhibitory Components Multi-domain immunomodulatory proteins were generated containing (1) at least one inhibitory receptor binding molecule (IRBM) that binds to an immune cell inhibitory receptor or inhibitory receptor complex (e.g. PD-1) and (2) at least one activating receptor binding molecule (ARBM) that binds to an immune cell activating receptor or activating receptor complex (e.g. CD28, CD3, CD4). Among binding molecules that were included as individual IRBM and ARBM in the multi-domain immunomodulatory proteins were non-antibody immunoglobulin superfamily (IgSF) domains, such as an extracellular domain (ECD) or immunoglobulin-like V-type (IgV) domain, or a variant IgSF domain (vIgD) that was affinity-modified and selected for increased binding affinity to the target binding partner compared to the unmodified or wild-type IgSF domain. Examples 8-13 below describe exemplary variant IgSF domains for inclusion as an IRBM or ARBM.

Exemplary IRBMs and ARBMs used in the immunomodulatory proteins are listed in Tables E1.A and E1.B, respectively.

TABLE E1.A

Exemplary Inhibitory Receptor Binding Molecule (IRBM)

| IRBM | SEQ ID NO |
|---|---|
| PD-L1 IgV 303: D43G/N45D/L56Q/V5 8A/G101G-ins (G101GG) | 303 |
| PD-L2 IgV 1417: H15Q/T47A/K65R/S67L/Q82R/V89D | 1417 |
| PD-L2 IgV 31: Wild-type | 31 |
| CD155 IgV 665 P18S/S65W/S67A/M90V/V95A/L104Q/G111R | 665 |

TABLE E1.B

Exemplary Activating Receptor Binding Molecule (ARBM)

| ARBM | SEQ ID NO |
|---|---|
| CD86 IgV 2610: Wild-type | 2610 |
| CD80 IgV 2615: Wild-type | 2615 |
| CD80 IgV 2617: E35G/K54E/A71D/L72P | 2617 |
| CD80 IgV 2616: V22L/E35G/A71D/L72P | 2616 |
| ICOSL IgV 2244: Wild-type | 2244 |
| ICOSL IgV 2266: N52H/Q100R | 2266 |
| ICOSL IgV 2264: N52H/N57Y/Q100R | 2264 |
| ICOSL IgV 2247: N52D | 2247 |
| ICOSL ECD 2266: N52H/Q100R | 2081 |
| CTLA-4 ECD 36: Wild-type | 36 |
| CTLA-4 ECD 2655: Wild-type | 2655 |
| CTLA-4 ECD 3495: Wild-type with C122S | 3495 |
| CTLA-4 ECD 3037: G29W/N58S/L63P/Q82R/L98Q/Y105L | 3037 |
| CTLA-4 ECD 2519: A31Y/L106E | 2519 |
| CTLA-4 ECD 2520 A31Y/L106E with C122S | 2520 |
| CTLA-4 ECD 3060 L12F/R16H/G29W/M56T/L98Q/Y105L | 3060 |

TABLE E1.B-continued

Exemplary Activating Receptor Binding Molecule (ARBM)

| ARBM | SEQ ID NO |
|---|---|
| LFA3 (CD58) Ig 3650 Wild-type | 3650 |
| Human IL16 | 2521 |
| Anti-CD3: OKT3-derived single chain variable fragment | 2522 |

Various multi-domain immunomodulatory proteins using the molecules listed above were generated in various configurations as summarized below. In some aspects, the configurations were chosen to affect spatial proximalization of ITIM bearing inhibitory receptors with activating receptors on T cells to make possible attenuation of T cell activation and/or tolerance induction (FIGS. 1A and 1B).

Figure 2:
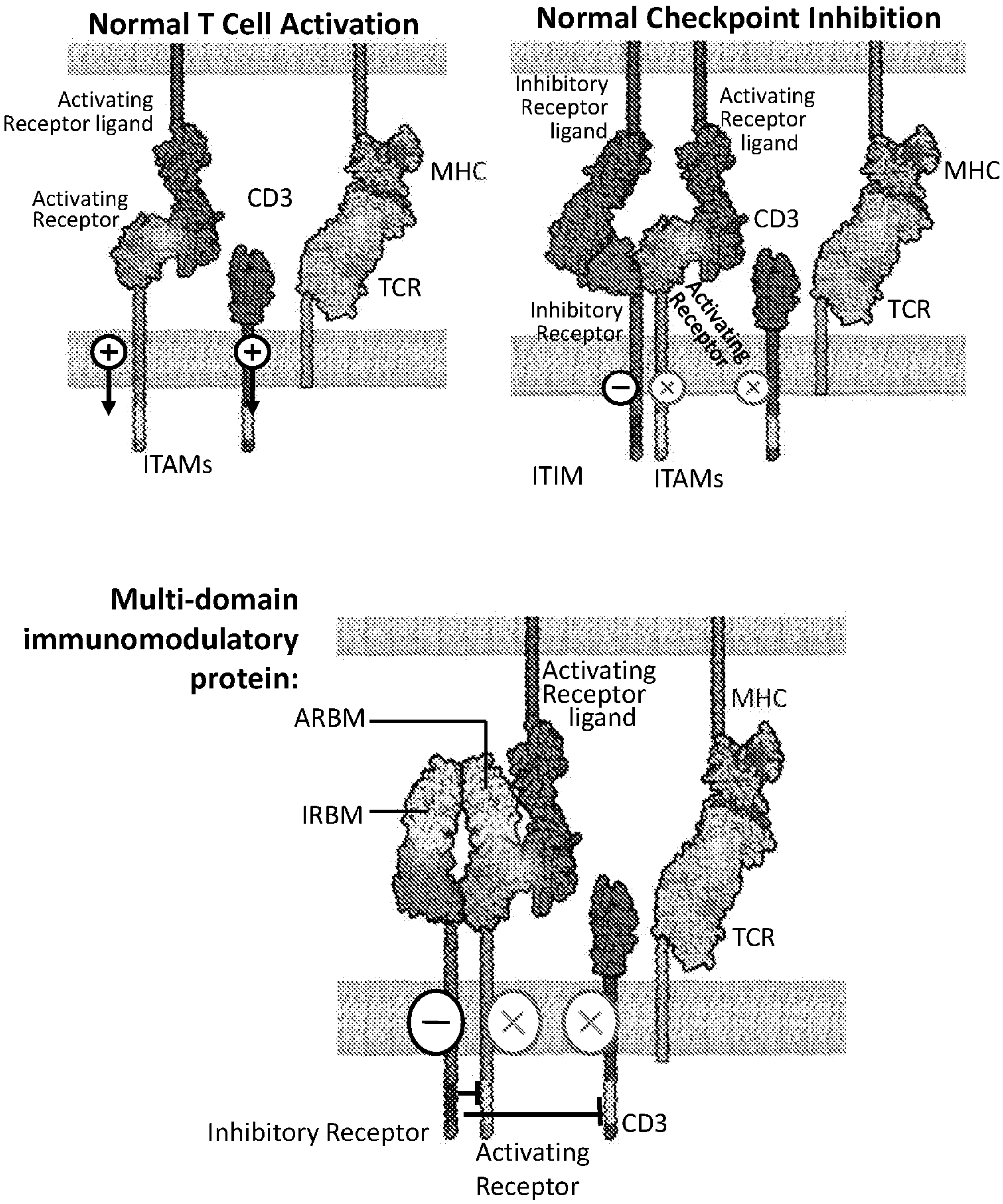
FIG. 2 depicts binding of the multi-domain immunomodulatory proteins in a cis binding strategy where an ARBM (e.g., ICOSL) binds the activating receptor (e.g. CD28) and an IRBM (e.g., PD-L1 or PD-L2) binds the inhibitory receptor (e.g., PD-1).

In some cases, multi-domain immunomodulatory proteins were generated in a cis binding strategy to target the inhibitory receptor (e.g. PD-1 or TIGIT) and activating receptor (e.g. CD2, CD3, CD4 or CD28) on T cells, which, in some cases, proximalize or cluster the inhibitory receptor and the activating receptor on the surface of the same T cell (FIG. 2). Exemplary generated cis-binding immunomodulatory molecules contained a PD-L1, PD-L2 or CD155 vIgD domain in combination with a binding molecule targeting CD28 (e.g. various ICOSL, CD80, and CD86 vIgD or wild-type IgsF domains), CD2 (e.g. CD58 wild-type IgSF domain) or with a binding molecule targeting CD3 or CD4.

In other cases, multi-domain immunomodulatory proteins were generated in a trans binding strategy to target the inhibitory receptor (e.g. PD-1 or TIGIT) on the T cell and a ligand of the activating receptor (e.g. CD80 or CD86) on an antigen-presenting cell (APC) (FIG. 1B). In the trans strategy, localization of the ligand, e.g. CD80/CD86, on the APC during immune synapse formation may be sufficient for signaling by the cognate activating receptor, e.g. CD28, and the presence of the immunomodulatory protein could antagonize such as a signal (e.g. B7/CD28 signaling) and instead present an inhibitory ligand (e.g. PD-1 binding ligand or TIGIT binding ligand) to recruit the inhibitory receptor (e.g. PD-1 or TIGIT) to the immune synapse. Exemplary generated trans-binding immunomodulatory molecules contained a PD-L1, PD-L2 and/or CD155 vIgD domain in combination with a CTLA-4 vIgD or wild-type IgSF domain.

The immunomodulatory proteins, in either a cis-binding strategy or trans-binding strategy configuration, were generated as either multimeric molecules via fusion with an Fc protein or as monomeric molecules.

A. Multimeric Configurations

In some configurations, the generated multi-domain immunomodulatory proteins were generated as multimeric proteins by fusion with an Fc molecule. The ARBM or IRBM of the multi-domain immunomodulatory protein were variously linked to the N- or C-terminus of a human IgG1 Fc region via a peptide linker, such as a GSGGS (SEQ ID NO: 2523), GGGGS (G4S; SEQ ID NO: 1942), GSGGGGS (SEQ ID NO: 1941), GGGGSGGGGS (2×GGGGS; SEQ ID NO: 240), GGGGSGGGGSGGGGS (3×GGGGS; SEQ ID NO: 239), GGGGSSA (SEQ ID NO: 2524) peptide linker, or combinations thereof.

For generating homodimeric Fc fusions, an exemplary IgG1 Fc region used in generated constructs had the sequence set forth in SEQ ID NO:1155 and contained the mutation C220S by EU numbering and the mutations L234A, L235E, and G237A, by EU numbering, to reduce effector function (the mutations corresponded to C5S, L19A, L20E, G22A, with reference to wild-type human IgG1 Fc set forth in SEQ ID NO:187). In some cases, the Fc used in the constructs had the sequence set forth in SEQ ID NO:1715, which further contained removal of the C-terminal lysine, K447del by EU numbering (corresponding to deletion of position 232, with reference to wild-type or unmodified Fc set forth in SEQ ID NO: 187).

In some cases, an exemplary IgG1 Fc region used in generated constructs had the sequence set forth in SEQ ID NO:3538 and contained the mutation C220S by EU numbering and contained amino acid substitutions E356D and M358L to reconstitute residues of allotype G1 m1, by EU numbering (the mutations corresponded to C5S, E141D, and M143L). In some embodiments, the wild-type IgG1 Fc can be the Fc set forth in SEQ ID NO: 187 having an allotype containing residues Glu (E) and Met (M) at positions 356 and 358 by EU numbering. In some embodiments, the Fc region further contained removal of the C-terminal lysine, K447del by EU numbering (corresponding to deletion of position 232) with reference to wild-type human IgG1 Fc set forth in SEQ ID NO:187).

In some aspects, a wild-type Fc was used that was modified by one or more amino acid substitutions to reduce effector activity or to render the Fc inert for Fc effector function such as effectorless mutations L234A, L235E and G237A by EU numbering or R292C, N297G and V302C by EU numbering. In some embodiments, a wild-type Fc was further modified by the removal of one or more cysteine residue, such as by replacement of the cysteine residues to a serine residue at position 220 (C220S) by EU numbering. Exemplary inert Fc regions having reduced effector function used in exemplary constructs are set forth in SEQ ID NO: 1158 and SEQ ID NO:3579, which are based on allotypes set forth in SEQ ID NO:187 or SEQ ID NO: 3538, respectively. In some embodiments, an Fc region used in a construct provided herein can further lack a C-terminal lysine residue, such as set forth in SEQ ID NO:1715. Another exemplary inert Fc region having reduced effector function used in exemplary constructs is set forth in SEQ ID NO:1157.

```
(wild-type IgG1 with C220S)
                                  SEQ ID NO: 3538
EPKSSDKTHTCPPCPAPELLGGPSVFLFPPKPKDTL

MISRTPEVTCVVVDVSHEDPEVKFNWYVDGVEVHNA
```

-continued

```
KTKPREEQYNSTYRVVSVLTVLHQDWLNGKEYKCKV

SNKALPAPIEKTISKAKGQPREPQVYTLPPSRDELT

KNQVSLTCLVKGFYPSDIAVEWESNGQPENNYKTTP

PVLDSDGSFFLYSKLTVDKSRWQQGNVFSCSVMHEA

LHNHYTQKSLSLSPG

                                  SEQ ID NO: 1155
EPKSSDKTHTCPPCPAPEAEGAPSVFLFPPKPKDTL

MISRTPEVTCVVVDVSHEDPEVKFNWYVDGVEVHNA

KTKPREEQYNSTYRVVSVLTVLHQDWLNGKEYKCKV

SNKALPAPIEKTISKAKGQPREPQVYTLPPSRDELT

KNQVSLTCLVKGFYPSDIAVEWESNGQPENNYKTTP

PVLDSDGSFFLYSKLTVDKSRWQQGNVFSCSVMHEA

LHNHYTQKSLSLSPGK

                                  SEQ ID NO: 1715
EPKSSDKTHTCPPCPAPEAEGAPSVFLFPPKPKDTL

MISRTPEVTCVVVDVSHEDPEVKFNWYVDGVEVHNA

KTKPREEQYNSTYRVVSVLTVLHQDWLNGKEYKCKV

SNKALPAPIEKTISKAKGQPREPQVYTLPPSRDELT

KNQVSLTCLVKGFYPSDIAVEWESNGQPENNYKTTP

PVLDSDGSFFLYSKLTVDKSRWQQGNVFSCSVMHEA

LHNHYTQKSLSLSPG

                                  SEQ ID NO: 1157
EPKSSDKTHTCPPCPAPELLGGPSVFLFPPKPKDTL

MISRTPEVTCVVVDVSHEDPEVKFNWYVDGVEVHNA

KTKPCEEQYGSTYRCVSVLTVLHQDWLNGKEYKCKV

SNKALPAPIEKTISKAKGQPREPQVYTLPPSREEMT

KNQVSLTCLVKGFYPSDIAVEWESNGQPENNYKTTP

PVLDSDGSFFLYSKLTVDKSRWQQGNVFSCSVMHEA

LHNHYTQKSLSLSPGK
```

Table E2 describes exemplary generated multi-domain homodimeric immunomodulatory Fc fusion proteins.

TABLE E2

| Multimeric Homodimer Multi-Domain Immunomodulatory Proteins | | | | | | |
|---|---|---|---|---|---|---|
| Description | DNA SEQ ID NO | Protein SEQ ID NO | ARBM (SEQ ID NO) | IRBM (SEQ ID NO) | Linker (SEQ ID NO) | Fc (SEQ ID NO) |
| PD-L1 vIgD Multimer and OKT3 scFv | | | | | | |
| Anti-CD3-PD-L1 303-PD-L1 303-PD-L1 303-Fc: OKT3-scFv_G4S_SA_PD-L1 303_2xG4S_PD-L1 303_2xG4S_PD-L1 303_2xG4S_Fc | 3234 | 2529 | Anti-CD3 scFv (2522) | PD-L1 IgV: D43G/N45D/L56Q/V58A/G101 G-ins (G101GG) (303) | GGGGS SA (2524) 2xG4S (240) | Fc (3579) |
| PD-L1 vIgD Multimer and IL16 ECD | | | | | | |
| IL16-PD-L1 303-PD-L1 303-PD-L1 303-Fc: IL16_G4S_SA_PD-L1 | 3235 | 2530 | IL16 (2521) | PD-L1 IgV: D43G/N45D/L56Q/V58A/G101 | GGGGS SA (2524) | Fc (3579) |

TABLE E2-continued

| Description | DNA SEQ ID NO | Protein SEQ ID NO | ARBM (SEQ ID NO) | IRBM (SEQ ID NO) | Linker (SEQ ID NO) | Fc (SEQ ID NO) |
|---|---|---|---|---|---|---|
| Multimeric Homodimer Multi-Domain Immunomodulatory Proteins | | | | | | |
| 303_2xG4S_PD-L1 303_2xG4S_ PD-L1 303_2xG4S_Fc | | | | G-ins (G101GG) (303) | 2xG4S (240) | |
| PD-L1/PD-L2 IgV and CTLA-4 ECD | | | | | | |
| CTLA-4 2520-PD-L1 303-Fc: CTLA-4-2520_GSGGS_2xG4S_ PD-L1 303_G4S_GS_G4S_Fc | 2532 | 2533 | CTLA-4-ECD: A31Y/L106E (2520) | PD-L1 IgV: D43G/N45D/L56Q/ V58A/G101 G-ins (G101GG) (303) | GSGGS (2523) 2xG4S (240) G4S (1942) GS_G4S (1941) | Fc (1715) |
| CTLA-4 2520-PD-L2 1417-Fc: CTLA-4-2520_GSGGS_2xG4S_ PD-L2 1417_G4S_GS_G4S_Fc | 2534 | 2535 | CTLA-4-ECD: A31Y/L106E (2520) | PD-L2 IgV: H15Q/T47A/K65R/ S67L/Q82R/ V89D (1417) | GSGGS (2523) 2xG4S (240) G4S (1942) GS_G4S (1941) | Fc (1715) |
| PD-L1 303-CTLA-4 2519-Fc: PD-L1 303_GSGGS_2xG4S_ CTLA-4 2519_G4S_GS_G4S_Fc | 2536 | 2537 | CTLA-4-ECD: A31Y/L106E (2519) | PD-L1 IgV: D43G/N45D/L56Q/ V58A/G101 G-ins (G101GG) (303) | GSGGS (2523) 2xG4S (240) G4S (1942) GS_G4S (1941) | Fc (1715) |
| PD-L2 1417-CTLA-4 2519-Fc: PD-L2 1417_GSGGS_2xG4S_ CTLA-4 2519_G4S_GS_G4S_Fc | 2538 | 2539 | CTLA-4-ECD: A31Y/L106E (2519) | PD-L2 IgV: H15Q/T47A/K65R/ S67L/Q82R/ V89D (1417) | GSGGS (2523) 2xG4S (240) G4S (1942) GS_G4S (1941) | Fc (1715) |
| PD-L1 303-Fc-CTLA-4 2520: PD-L1 303_GSGGS_G4S_Fc_ 3xGGGGS_CTLA-4 2520 | 2540 | 2541 | CTLA-4-ECD: A31Y/L106E (2520) | PD-L1 IgV: D43G/N45D/L56Q/ V58A/G101 G-ins (G101GG) (303) | GSGGS (2523) G4S (1942) 3xG4S (239) | Fc (1715) |
| PD-L2 1417-Fc-CTLA-4 2520: PD-L2 1417_GSGGS_G4S_Fc_ 3xGGGGS_CTLA-42520 | 2542 | 2543 | CTLA-4-ECD: A31Y/L106E (2520) | PD-L2 IgV: H15Q/T47A/K65R/ S67L/Q82R/ V89D (1417) | GSGGS (2523) G4S (1942) 3xG4S (239) | Fc (1715) |
| PD-L1 303-CTLA-4 3495-Fc: PD-L1 303_GSGGS_G4Sx2_ CTLA-4 3495_G4S_GSG4S_Fc | 3561 | 3518 | CTLA-4-wild-type (3495) | PD-L1 IgV: D43G/N45D/L56Q/ V58A/G101 G-ins (G101GG) (303) | GSGGS (2523) 2xG4S (240) G4S (1942) GSG4S (1941) | Fc (1715) |
| PD-L2 1417-CTLA-4 3495-Fc: PD-L2 1417_GSGGS_G4Sx2_ CTLA-4 3495_G4S_GSG4S_Fc | 3562 | 3519 | CTLA-4-wild-type (3495) | PD-L2 IgV: H15Q/T47A/K65R/ S67L/Q82R/ V89D (1417) | GSGGS (2523) 2xG4S (240) G4S (1942) GSG4S (1941) | Fc (1715) |
| CTLA-4 2655-PD-L1 303 -Fc: CTLA-4 2655_GSGGS_G4Sx2_ PD-L1 303_G4S_GSG4S_Fc | 3563 | 3520 | CTLA-4-wild-type (2655) | PD-L1 IgV: D43G/N45D/L5 6Q/V58A/G101 G-ins (G101GG) (303) | GSGGS 2xG4S (2523) (240) G4S (1942) GSG4S (1941) | Fc (1715) |

TABLE E2-continued

| Description | DNA SEQ ID NO | Protein SEQ ID NO | ARBM (SEQ ID NO) | IRBM (SEQ ID NO) | Linker (SEQ ID NO) | Fc (SEQ ID NO) |
|---|---|---|---|---|---|---|
| **Multimeric Homodimer Multi-Domain Immunomodulatory Proteins** | | | | | | |
| PD-L1 303-CTLA-4 2655-Fc: PD-L1 303_GSGGS_G4Sx2_ CTLA-4 2655_G4S_GSG4S_Fc | 3564 | 3521 | CTLA-4-wild-type (2655) | PD-L1 IgV: D43G/N45D/L56Q/ V58A/G101 G-ins (G101GG) (303) | GSGGS (2523) 2xG4S (240) G4S (1942) GSG4S (1941) | Fc (1715) |
| CTLA-4 3037-PD-L1 303-Fc: CTLA-4 3037_GSGGS_G4Sx2_ PD-L1 303_G4S_GSG4S_Fc | 3565, 3665 | 3522, 3666 | CTLA-4-G29W/N58S/ L63P/Q82R/ L98Q/Y105L (3037) | PD-L1 IgV: D43G/N45D/L56Q/ V58A/G101 G-ins (G101GG) (303) | GSGGS (2523) 2xG4S (240) G4S (1942) GSG4S (1941) | Fc (1715) |
| PD-L1 303-CTLA-4 3037-Fc: PD-L1 303_CTLA-4 3037_ GSGGS_G4Sx2_G4S_GSG4S_Fc | 3566, 3667 | 3523, 3668 | CTLA-4-G29W/N58S/ L63P/Q82R/ L98Q/Y105L (3037) | PD-L1 IgV: D43G/N45D/L56Q/ V58A/G101 G-ins (G101GG) (303) | GSGGS (2523) 2xG4S (240) G4S (1942) GSG4S (1941) | Fc (1715) |
| PD-L1 303-Fc-CTLA-4 3037: PD-L1 303_GSG4S_Fc_G4Sx3_ CTLA-4 3037 | 3567 | 3524 | CTLA-4-G29W/N58S/ L63P/Q82R/ L98Q/Y105L (3037) | PD-L1 IgV: D43G/N45D/L56Q/ V58A/G101 G-ins (G101GG) (303) | GSG4S (1941) 3xG4S (239) | Fc (1715) |
| CTLA-4 3037-Fc-PD-L1 303: CTLA-4 3037_GSG4S_Fc_PD-L1 303 | 3669 | 3670 | CTLA-4-G29W/N58S/ L63P/Q82R/ L98Q/Y105L (3037) | PD-L1 IgV: D43G/N45D/L56Q/ V58A/G101 G-ins (G101GG) (303) | GSG4S (1941) 3xG4S (239) | Fc (1715) |
| CTLA4 3037-Fc-PD-L1 303: CTLA-4 3037_GSG4S_Fc_3xG4S_PD-L1 303 | 3671 | 3672 | CTLA-4-G29W/N58S/ L63P/Q82R/ L98Q/Y105L (3037) | PD-L1 IgV: D43G/N45D/L56Q/ V58A/G101 G-ins (G101GG) (303) | GSG4S (1941) 3xG4S (239) | Fc (1715) |
| CTLA-4 3060-PD-L1 303-Fc: CTLA-4 3060_GSGGS(G4S)2_PD-L1 303_G4SGSG4S_Fc | 3673 | 3674 | CTLA-4-L12F/R16H/ G29W/M56T/ L98Q/Y105L ECD | PD-L1 IgV: D43G/N45D/L56Q/ V58A/G101 G-ins (G101GG) (303) | GSGGS (2523) 2x G4S (240) G4S (1942) GSG4S (1941) | Fc (1715) |
| PD-L1 303-CTLA4 3060-Fc PD-L1 303_GSGGS(G4S)2_CTLA-4 3060_G4SGSG4S_Fc | 3675 | 3676 | CTLA-4-L12F/R16H/ G29W/M56T/ L98Q/Y105L ECD | PD-L1 IgV: D43G/N45D/L56Q/ V58A/G101 G-ins (G101GG) (303) | GSGGS (2523) 2x G4S (240) G4S (1942) GSG4S (1941) | Fc (1715) |
| **PD-L1 IgV Multimers and CTLA-4 ECD** | | | | | | |
| CTLA-4 2519-PD-L1 303-PD-L1 303-PD-L1 303-Fc: CTLA-4 2519_G4S_SA_PD-L1 303_G4Sx2_PD-L1 303_G4Sx2_ PD-L1 303_G4Sx2_Fc | 3236 | 2531 | CTLA-4-ECD: A31Y/L106E (2519) | PD-L1 IgV: D43G/N45D/L56Q/ V58A/G101 G-ins (G101GG) (303) | GGGGS SA (2524) 2xG4S (240) | Fc (3579) |

TABLE E2-continued

Multimeric Homodimer Multi-Domain Immunomodulatory Proteins

| Description | DNA SEQ ID NO | Protein SEQ ID NO | ARBM (SEQ ID NO) | IRBM (SEQ ID NO) | Linker (SEQ ID NO) | Fc (SEQ ID NO) |
|---|---|---|---|---|---|---|
| PD-L1 IgV and ICOSL IgV | | | | | | |
| PD-L1 303-ICOSL 2266-Fc: PD-L1 303_GSGGS_G4Sx2_ ICOSL 2266_G4S_GSG4S_Fc | 3559 | 3516 | ICOSL IgV: N52H/Q100R (2266) | PD-L1 IgV: D43G/N45D/L56Q/ V58A/G101 G-ins (G101GG) (303) | GSGGS (2523) 2xG4S (240) G4S (1942) GSG4S (1941) | Fc (1715) |
| PD-L1 303-ICOSL 2264-Fc: PD-LI 303_GSGGS_G4Sx2_ ICOSL 2264_G4S_GSG4S_Fc | 3560 | 3517 | ICOSL IgV: N52H/N57Y/ Q100R (2264) | PD-L1 IgV: D43G/N45D/L56Q/ V58A/G101 G-ins (G101GG) (303) | GSGGS (2523) 2xG4S (240) G4S (1942) GSG4S (1941) | Fc (1715) |
| CD155 IgV and CTLA-4 ECD | | | | | | |
| CTLA-4 3060-CD 155 665-Fc CTLA-4 3060_G4Sx3_CD 155 665_GSG4S_Fc | 3651 | 3652 | CTLA-4- L12F/R16H/ G29W/M56T/ L98Q/Y105L (3060) | CD155 IgV: P18S/S65W/S6 7A/M90V/V95A/ L104Q/G111R (665) | 3xG4S (239) GSG4S (1941) | Fc (1715) |
| CD 155 665-CTLA-4 3037-Fc CD 155 665_G4SX3_CTLA-4 3037_GSG4S_Fc | 3653 | 3654 | CTLA-4- G29W/N58S/ L63P/Q82R/ L98Q/Y105L (3037) | CD155 IgV: P18S/S65W/S67A/ M90V/V95A/ L104Q/G111R (665) | 3xG4S (239) GSG4S (1941) | Fc (1715) |
| CD155 IgV/PDL1 IgV and CTLA-4ECD | | | | | | |
| PD-L1 303 -CD155 665-CTLA-4 3037-Fc PD-L1 303_3XG4S_CD155 665_3XG4S_CTLA-4 3037_GSG4S_Fc | 3663 | 3664 | CTLA-4- G29W/N58S/ L63P/Q82R/ L98Q/Y105L (3037) | PD-L1 IgV: D43G/N45D/L56Q/ V58A/G101 G-ins (G101GG) (303) CD155 IgV: P18S/S65W/S67A/ M90V/V95A/ L104Q/G111R (665) | 3xG4S (239) GSG4S (1941) | Fc (1715) |
| CD155 IgV and CD58 Ig | | | | | | |
| CD155 665-CD58 3650-Fc CD155 665_3XG4S_CD58 3650_GSG4S_Fc | 3659 | 3660 | CD58 wild-type (3650) | CD155 IgV: P18S/S65W/S67A/ M90V/V95A/ L104Q/G111R (665) | 3xG4S (239) GSG4S (1941) | Fc (1715) |
| CD58 3650-CD155 665-Fc CD58 3650_3XG4S_CD155 665_GSG4S_Fc | 3661 | 3662 | CD58 wild-type (3650) | CD155 IgV: P18S/S65W/S67A/ M90V/V95A/ L104Q/G111R (665) | 3xG4S (239) GSG4S (1941) | Fc (1715) |
| PD-L1/L2 IgV and CD58 Ig | | | | | | |
| CD58 3650-PD-L1 303-Fc CD58 365O_3XG4S_PD-L1 303_GSG4S_Fc | 3679 | 3680 | CD58 wild-type (3650) | PD-L1 IgV: D43G/N45D/L56Q/ V58A/G101 G-ins (G101GG) (303) | 3xG4S (239) GSG4S (1941) | Fc (1715) |
| PD-L1 303-CD58 3650-Fc PD-L1 303_3XG4S_CD58 3650_GSG4S_Fc | 3681 | 3682 | CD58 wild-type (3650) | PD-L1 IgV: D43G/N45D/L56Q/ V58A/G101 G-ins (G101GG) (303) | 3xG4S (239) GSG4S (1941) | Fc (1715) |

TABLE E2-continued

| Multimeric Homodimer Multi-Domain Immunomodulatory Proteins | | | | | | |
|---|---|---|---|---|---|---|
| Description | DNA SEQ ID NO | Protein SEQ ID NO | ARBM (SEQ ID NO) | IRBM (SEQ ID NO) | Linker (SEQ ID NO) | Fc (SEQ ID NO) |
| Reference | | | | | | |
| CTLA-4 3037-Fc: CTLA-4 3037_GSG4S_Fc | 3572 | 3529 | CTLA-4-G29W/N58S/L63P/Q82R/L98Q/Y105L (3037) | — | GSG4S (1941) | Fc (1715) |
| CTLA-4 36-Fc: CTLA-4 36_GSG4S_Fc | 3573 | 3530 | CTLA-4-wild-type (36) | — | GSG4S (1941) | Fc (1715) |
| ICOSL 2081-Fc | 3536 | 3537 | ICOSL ECD: N52H/Q100R (2081) | — | AAA | Fc (1157) |
| PD-L1 303-Fc: PD-L1 303_GSG4S_Fc | 3574 | 3531 | — | PD-L1 IgV: D43G/N45D/L56Q/V58A/G101 G-ins (G101GG) (303) | 2xG4S (240) | Fc (1715) |
| PD-L2 303-Fc: PD-L2 31_AAA_Fc | 3575 | 3532 | — | PD-L2 ECD: Wild-type (31) | AAA | Fc (1157) |
| PD-L1 303-Fc: PD-L1 303_GSGGS_G4S_Fc | 3539 | 3540 | — | PD-L1 IgV: D43G/N45D/L56Q/V58A/G101 G-ins (G101GG) (303) | GSGGS (2523) G4S (1942) | Fc (3538) |
| PD-L1 303-PD-L1 303-Fc: PD-L1 303_G4Sx3_PD-L1 303_GSG4S_Fc | 3541 | 3542 | — | PD-L1 IgV: D43G/N45D/L56Q/V58A/G101 G-ins (G101GG) (303) | 3xG4S (239) GSG4S (1941) | Fc (3538) |

In some configurations, the generated multi-domain immunomodulatory Fc fusion proteins further contained a moiety for detection and/or purification, such as a poly-histidine tag (HHHHHH; SEQ ID NO: 2011) or a flag-tag (DYKDDDDK; SEQ ID NO: 2010). In such examples, the resulting immunomodulatory Fc fusion protein was generated as a heterodimer in which the ARBM or IRBM were each tagged with a different moiety and each fused to either an Fc K chain or an Fc D chain as part of the K/D chain system. In exemplary generated molecules, the exemplary K chain set forth in SEQ ID NO:2544 contained mutations to positively charged residues (E356K, E357K and D399K by EU numbering) and the exemplary D chain set forth in SEQ ID NO: 2545 contained mutations to negatively charged residues (K370D, K392D and K409D by EU numbering), such that, when co-expressed in a cell, association between the K and D chains was possible but the chains did not substantially self-associate due to charge repulsion. In addition, the above mutations were made in an Fc backbone having an allotype containing residues Glu (E) and Met (M) at positions 356 and 358, and also contained mutations C220S, L234A, L235E and G237A by EU numbering.

```
K- chain,
                                        SEQ ID NO: 2544
EPKSSDKTHTCPPCPAPEAEGAPSVFLFPPKPKDTL

MISRTPEVTCVVVDVSHEDPEVKFNWYVDGVEVHNA
```

-continued

```
KTKPREEQYNSTYRVVSVLTVLHQDWLNGKEYKCKV

SNKALPAPIEKTISKAKGQPREPQVYTLPPSRKKMT

KNQVSLTCLVKGFYPSDIAVEWESNGQPENNYKTTP

PVLKSDGSFFLYSKLTVDKSRWQQGNVFSCSVMHEA

LHNHYTQKSLSLSPG

D-chain,
                                        SEQ ID NO: 2545
EPKSSDKTHTCPPCPAPEAEGAPSVFLFPPKPKDTL

MISRTPEVTCVVVDVSH EDPEVKFNWYVDGVEVHNA

KTKPREEQYNSTYRVVSVLTVLHQDWLNGKEYKCKV

SNKALPAPIEKTISKAKGQPREPQVYTLPPSREEMT

KNQVSLTCLVDGFYPSDIAVEWESNGQPENNYDTTP

PVLDSDGSFFLYSDLTVDKSRWQQGNVFSCSVMHEA

LHNHYTQKSLSLSPG
```

Table E3A describe exemplary generated multi-domain immunomodulatory Fc fusion proteins.

TABLE E3A

Multimeric Heterodimer Multi-Domain Immunomodulatory Proteins

| Description | DNA SEQ ID NO | Protein SEQ ID NO | ARBM (SEQ ID NO) | IRBM (SEQ ID NO) | Linker (SEQ ID NO) | Fc | Moiety |
|---|---|---|---|---|---|---|---|
| PD-L1/PD-L2 vIgD and ICOSLvIgD | | | | | | | |
| PD-L2 1417 − Fc + ICOSL 2244 − Fc: (1) PD-L2 1417_G4S_Fc K chain_Flag | 2546 | 2547 | — | PD-L2 IgV: H15Q/T47A/ K65R/S67L/ Q82R/V89D (1417) | G4S (1942) | K chain (2544) | Flag tag (2010) |
| (2) ICOSL 2244 2244_G4S_Fc D chain_His | 2548 | 2549 | ICOSL IgV: wildtype (2244) | — | G4S (1942) | D chain (2545) | His tag (2011) |
| PD-L2 1417 − Fc + ICOSL 2264 − Fc: (1) PD-L2 1417_G4S_Fc K chain_Flag | 2546 | 2547 | — | PD-L2 IgV: H15Q/T47A/ K65R/S67L/ Q82R/V89D (1417) | G4S (1942) | K chain (2544) | Flag tag (2010) |
| (2) ICOSL 2264_G4S_Fc D chain_His | 2550 | 2551 | ICOSL IgV: N52H/ N57Y/ Q100R (2264) | — | G4S (1942) | D chain (2545) | His tag (2011) |
| PD-L1 303 − Fc + ICOSL 2244 − Fc: (1) PD-L1 303_G4S_Fc K chain_Flag | 2552 | 2553 | — | PD-L1 IgV: D43G/N45D/ L56Q/V58A/ G101G-ins (G101GG) (303) | G4S (1942) | K chain (2544) | Flag tag (2010) |
| (2) ICOSL 2244_G4S_Fc D chain_His | 2548 | 2549 | ICOSL IgV: wildtype (2244) | — | G4S (1942) | D chain (2545) | His tag (2011) |
| PD-L1 303 − Fc + ICOSL 2264 − Fc: (1) PD-L1 303_G4S_Fc K chain_Flag | 2552 | 2553 | — | PD-L1 IgV: D43G/N45D/ L56Q/V58A/ G101G-ins (G101GG) (303) | G4S (1942) | K chain (2544) | Flag tag (2010) |
| (2) ICOSL 2264_G4S_Fc D chain_His | 2550 | 2551 | ICOSL IgV: N52H/ N57Y/ Q100R (2264) | — | G4S (1942) | D chain (2545) | His tag (2011) |
| PD-L1/PD-L2 vIgD and CD80/CD86 vIgD | | | | | | | |
| PD-L2 1417 − Fc + CD80 2615 − Fc: (1) PD-L2 1417_G4S_Fc K chain_Flag | 2546 | 2547 | — | PD-L2 IgV: H15Q/T47A/ K65R/S67L/ Q82R/V89D (1417) | G4S (1942) | K chain (2544) | Flag tag (2010) |
| (2) CD80 2615_G4S_Fc D chain_His | 2554 | 2555 | CD80 IgV: wildtype (2615) | — | G4S (1942) | D chain (2545) | His tag (2011) |
| PD-L2 1417 − Fc + CD80 1152 − Fc: (1) PD-L2 1417_G4S_Fc K chain_Flag | 2546 | 2547 | — | PD-L2 IgV: H15Q/T47A/ K65R/S67L/ Q82R/V89D (1417) | G4S (1942) | K chain (2544) | Flag tag (2010) |
| (2) CD80 1121_G4S_Fc D chain_His | 2556 | 2557 | CD80 IgV: V22L/ E35G/ A71D/ L72P (2616) | — | G4S (1942) | D chain (2545) | His tag (2011) |
| PD-L1 303 − Fc + CD80 2615 − Fc: (1) PD-L1 303_G4S_Fc K chain_Flag | 2552 | 2553 | — | PD-L1 IgV: D43G/N45D/ L56Q/V58A/ G101G-ins (G101GG) (303) | G4S (1942) | K chain (2544) | Flag tag (2010) |
| (2) CD80 2615_G4S_Fc D chain_His | 2554 | 2555 | CD80 IgV: wildtype (2615) | — | G4S (1942) | D chain (2545) | His tag (2011) |
| PD-L1 303 − Fc + CD80 2616 − Fc: (1) PD-L1 303_G4S_Fc | 2552 | 2553 | — | PD-L1 IgV: D43G/N45D/ L56Q/V58A/ G101G-ins | G4S (1942) | K chain (2544) | Flag tag (2010) |

TABLE E3A-continued

| Multimeric Heterodimer Multi-Domain Immunomodulatory Proteins | | | | | | | |
|---|---|---|---|---|---|---|---|
| Description | DNA SEQ ID NO | Protein SEQ ID NO | ARBM (SEQ ID NO) | IRBM (SEQ ID NO) | Linker (SEQ ID NO) | Fc | Moiety |
| K chain_Flag | | | | (G101GG) (303) | | | |
| (2) CD80 1121_G4S_Fc D chain_His | 2556 | 2557 | CD80 IgV: V22L/ E35G/ A71D/ L72P (2616) | — | G4S (1942) | D chain (2545) | His tag (2011) |

In another strategy, multimeric multi-domain immunomodulatory proteins were generated as heterodimeric molecules by "knobs-into-hole" engineering. In such an example, the heterodimer was generated by co-expressing an ARBM and an IRBM that each were fused to either (1) a first "knob" Fc subunit (set forth in SEQ ID NO:1153 or 2558 containing the mutations S354C and T366W by EU numbering, corresponding to S139C and T151W with reference to wild-type human IgG1 Fc set forth in SEQ ID NO:187); and (2) a second "hole" Fc subunit (set forth in SEQ ID NO:1154 and 2559, containing the mutations Y349C, T366S, L368A and Y407V by EU numbering, corresponding to Y134C, T151S, L153A and Y192V with reference to wild-type human IgG1 Fc set forth in SEQ ID NO:187) for expression of a heterodimeric molecule. In addition, both the knob and hole Fc also contained mutations L19A, L20E, G22A to reduce effector function and contained replacement of the cysteine residue to a serine residue at position 5 (C5S), each compared to the wild-type or unmodified Fc set forth in SEQ ID NO: 187 (corresponding to C220S, L234A, L235E and G237A by EU numbering, respectively). Each chain of the heterodimer also further contained a moiety for detection and/or purification, such as a poly-histidine tag (HHHHHH; SEQ ID NO: 2011) or a flag-tag (DYKDDDDK; SEQ ID NO: 2010).

```
Knob Fc (SEQ ID NO: 1153):
EPKSSDKTHTCPPCPAPEAEGAPSVFLFPPKPKDTL

MISRTPEVTCVVVDVSHEDPEVKFNWYVDGVEVHNA

KTKPREEQYNSTYRVVSVLTVLHQDWLNGKEYKCKV

SNKALPAPIEKTISKAKGQPREPQVYTLPPCREEMT

KNQVSLWCLVKGFYPSDIAVEWESNGQPENNYKTTP

PVLDSDGSFFLYSKLTVDKSRWQQGNVFSCSVMHEA

LHNHYTQKSLSLSPGK
```

-continued

```
Knob Fc (SEQ ID NO: 2558):
EPKSSDKTHTCPPCPAPEAEGAPSVFLFPPKPKDTL

MISRTPEVTCVVVDVSHEDPEVKFNWYVDGVEVHNA

KTKPREEQYNSTYRVVSVLTVLHQDWLNGKEYKCKV

SNKALPAPIEKTISKAKGQPREPQVYTLPPCREEMT

KNQVSLWCLVKGFYPSDIAVEWESNGQPENNYKTTP

PVLDSDGSFFLYSKLTVDKSRWQQGNVFSCSVMHEA

LHNHYTQKSLSLSPG

Hole Fc (SEQ ID NO: 1154):
EPKSSDKTHTCPPCPAPEAEGAPSVFLFPPKPKDTL

MISRTPEVTCVVVDVSHEDPEVKFNWYVDGVEVHNA

KTKPREEQYNSTYRVVSVLTVLHQDWLNGKEYKCKV

SNKALPAPIEKTISKAKGQPREPQVCTLPPSREEMT

KNQVSLSCAVKGFYPSDIAVEWESNGQPENNYKTTP

PVLDSDGSFFLVSKLTVDKSRWQQGNVFSCSVMHEA

LHNHYTQKSLSLSPGK

Hole Fc (SEQ ID NO: 2559):
EPKSSDKTHTCPPCPAPEAEGAPSVFLFPPKPKDTL

MISRTPEVTCVVVDVSHEDPEVKFNWYVDGVEVHNA

KTKPREEQYNSTYRVVSVLTVLHQDWLNGKEYKCKV

SNKALPAPIEKTISKAKGQPREPQVCTLPPSREEMT

KNQVSLSCAVKGFYPSDIAVEWESNGQPENNYKTTP

PVLDSDGSFFLVSKLTVDKSRWQQGNVFSCSVMHEA

LHNHYTQKSLSLSPG
```

Table E3B describe exemplary generated multi-domain immunomodulatory Fc fusion proteins.

TABLE E3B

| Multimeric Heterodimer Multi-Domain Immunomodulatory Proteins | | | | | | | |
|---|---|---|---|---|---|---|---|
| Description | DNA SEQ ID NO | Protein SEQ ID NO | ARBM (SEQ ID NO) | IRBM (SEQ ID NO) | Linker (SEQ ID NO) | Fc | Moiety |
| PD-L1/PD-L2 vIgD and CTLA-4 ECD | | | | | | | |
| CTLA-4 2519 − Fc + PD-L2 1417 − Fc: | 2525 | 2526 | CTLA-4 ECD: | — | G4S (1942) | Knob Fc | Hag (2010) |

TABLE E3B-continued

| Description | DNA SEQ ID NO | Protein SEQ ID NO | ARBM (SEQ ID NO) | IRBM (SEQ ID NO) | Linker (SEQ ID NO) | Fc | Moiety |
|---|---|---|---|---|---|---|---|
| Multimeric Heterodimer Multi-Domain Immunomodulatory Proteins | | | | | | | |
| (1) CTLA-4 2519_G4S_Knob Fc_Flag | | | A31Y/ L106E (2519) | | | (1153) | |
| (2) PD-L2 1417_GSGGS_ 2 × G4S_Hole Fc_His | 2527 | 2528 | — | PD-L2 IgV: H15Q/T47A/ K65R/S67L/ Q82R/V89D (1417) | GSGGS (2523) 2 × G4S (240) | Hole Fc (1154) | His (2011) |
| CTLA-4 2519 − Fc + PD-L1 303 − Fc: (1) CTLA-4 variant ECD_G4S_ KnobFc_Flag | 2525 | 2526 | CTLA-4 ECD: A31Y/ L106E (2519) | — | G4S (1942) | Knob Fc (1153) | Hag (2010) |
| (2) PD-L1 303_GSGGS_ 2 × G4S_Hole Fc_His | 2560 | 2561 | — | PD-L1 IgV: D43G/N45D/ L56Q/V58A/ G101G-ins (G101GG) (303) | GSGGS (2523) 2 × G4S (240) | Hole Fc (1154) | His (2011) |
| PD-L1/PD-L2 vIgD and ICOSLvIgD | | | | | | | |
| PD-L1 303 − ICOSL 2266 − Fc + Fc: (1) PD-L1 303_ICOSL 2266_G4S_ Knob Fc_Flag | 3556 | 3513 | ICOSL IgV: N52H/ Q100R (2266) | PD-L1 IgV: D43G/N45D/ L56Q/V58A/ G101G-ins (G101GG) (303) | GSGGS (2523) 2 × G4S (240) G4S (1942) GSG4S (1941) | Knob Fc (1153) | — |
| (2) Stuffer_ AAA_ Hole Fc | 3557 | 3514 | — | — | AAA | Staffer (1156) Hole Fc (1154) | — |
| PD-L1 303 − ICOSL 2264 − Fc + Fc: (1) PD-L1 303_GSGGS_ 2 × G4S ICOSL 2264_G4S_ GSG4S_ Knob Fc | 3558 | 3515 | ICOSL IgV: N52H/ N57Y/ Q100R (2264) | PD-L1 IgV: D43G/N45D/ L56Q/V58A/ G101G-ins (G101GG) (303) | GSGGS (2523) 2 × G4S (240) G4S (1942) GSG4S (1941) | Knob Fc (1153) | — |
| (2) Stuffer_ AAA_ Hole Fc | 3557 | 3514 | — | — | AAA | Staffer (1156) Hole Fc (1154) | — |
| Reference | | | | | | | |
| PD-L1 303 − Fc + Fc: (1) Stuffer_ AAA_ Knob Fc | 3576 | 3533 | — | — | AAA | Knob Fc (1153) | — |
| (2) PD-L1 303_GSGGS_ 2 × G4S_ Hole Fc_His | 3577 | 3534 | — | PD-L1 IgV: D43G/N45D/ L56Q/V58A/ G101G-ins (G101GG) (303) | GSGGS (2523) 2 × G4S (240) | Hole Fc (2559) | His (2011) |
| PD-L2 1417 − Fc + Fc: (1) Stuffer_ AAA_ Knob Fc | 3576 | 3533 | — | — | AAA | Knob Fc (1153) | — |
| (2) PD-L2 1417_GSGGS_ | 3581 | 3512 | — | PD-L2 IgV: H15Q/T47A/ | GSGGS (2523) | Hole Fc | His (2011) |

TABLE E3B-continued

| Description | DNA SEQ ID NO | Protein SEQ ID NO | ARBM (SEQ ID NO) | IRBM (SEQ ID NO) | Linker (SEQ ID NO) | Fc | Moiety |
|---|---|---|---|---|---|---|---|
| Multimeric Heterodimer Multi-Domain Immunomodulatory Proteins | | | | | | | |
| 2 × G4 S_ Hole Fc_His | | | | K65R/S67L/ Q82R/V89D (1417) | 2 × G4S (240) | (2559) | |

In some cases, the multimeric multi-domain immunomodulatory proteins were generated as trimeric, tetrameric, or pentameric molecules. In such configurations, the immunomodulatory proteins containing an ARBM and IRBM were generated as fusions with: a portion of the cartilage oligomeric matrix protein (COMP) assembly domain as set forth in SEQ ID NO: 3503 (e.g. amino acids 29-72 of the full length COMP, Uniprot accession number P49747) for promoting pentamerization of the proteins; a vasodilator-stimulated phosphoprotein (VASP) tetramerization domain as set forth in SEQ ID NO: 3504 (e.g. amino acids 343-375 of the full length VASP; Uniprot accession number P50552) for promoting tetramerization of the proteins; or a ZymoZipper (ZZ) 12.6 domain as set forth in SEQ ID NO: 3505 (See U.S. Pat. No. 7,655,439) for promoting trimerization of the proteins. The multi-domain immunomodulatory proteins also further contained a moiety for detection and/or purification, such as a poly-histidine tag (HHHHHH; SEQ ID NO: 2011), flag-tag (DYKDDDDK; SEQ ID NO: 2010), or both.

Table E4 describe exemplary generated multimeric multi-domain immunomodulatory Fc fusion proteins.

TABLE E4

| Description | DNA SEQ ID NO | Protein SEQ ID NO | ARBM (SEQ ID NO) | IRBM (SEQ ID NO) | Linker (SEQ ID NO) | Multimerization Domain (SEQ ID NO) | Moiety (SEQ ID NO) |
|---|---|---|---|---|---|---|---|
| Multimeric Heterodimer Multi-Domain Immunomodulatory Proteins | | | | | | | |
| PD-L1/PD-L2 IgV and ICOSL IgV | | | | | | | |
| PD-L1 303 − ICOSL 2264 − COMP: PD-L1 303_3 × G4S_ ICOSL 2264 3 × G4S_ COMP_Flag_His | 3551 | 3507 | ICOSL IgV: N52H/ N57Y/ Q100R (2264) | PD-L1 IgV: D43G/N45D/ L56Q/V58A/ G101G-ins (G101GG) (303) | 3 × G4S (239) | COMP (3503) | Flag (2010) His (2011) |
| PD-L1 303 − ICOSL 2264 − VASP: PD-L1 303_3 × G4S_ ICOSL 2264 3 × G4S_ VASP_Flag_His | 3553 | 3509 | ICOSL IgV: N52H/ N57Y/ Q100R (2264) | PD-L1 IgV: D43G/N45D/ L56Q/V58A/ G101G-ins (G101GG) (303) | 3 × G4S (239) | VASP (3504) | Flag (2010) His (2011) |
| PD-L1 303 − 3 × G4S −ICOSL 2264 − G4S ZZ12.6 FLAG His6 | 3677 | 3678 | ICOSL IgV: N52H/ N57Y/ Q100R (2264) | PD-L1 IgV: D43G/N45D/ L56Q/V58A/ G101G-ins (G101GG) (303) | 3 × G4S (239) | ZZ12.6 (3505) | Flag (2010) His (2011) |
| Reference | | | | | | | |
| PD-L1 303 − COMP: PD-L1 303_3 × G4S_ COMP_Flag_His | 3550 | 3506 | — | PD-L1 IgV: D43G/N45D/ L56Q/V58A/ G101G-ins (G101GG) (303) | 3 × G4S (239) | COMP (3503) | Flag (2010) His (2011) |
| PD-L1 303 − VASP: PD-L1 303_3 × G4S_ VASP_Flag_His | 3552 | 3508 | — | PD-L1 IgV: D43G/N45D/ L56Q/V58A/ G101G-ins (G101GG) (303) | 3 × G4S (239) | VASP (3504) | Flag (2010) His (2011) |
| ZZ12.6-PD-L1 303: Flag_His_G4S_ ZZ12.6_PD-L1 303 | 3554 | 3510 | — | PD-L1 IgV: D43G/N45D/ L56Q/V58A/ G101G-ins (G101GG) (303) | G4S (1942) | ZZ12.6 (3505) | Flag (2010) His (2011) |

TABLE E4-continued

| Multimeric Heterodimer Multi-Domain Immunomodulatory Proteins | | | | | | | |
|---|---|---|---|---|---|---|---|
| Description | DNA SEQ ID NO | Protein SEQ ID NO | ARBM (SEQ ID NO) | IRBM (SEQ ID NO) | Linker (SEQ ID NO) | Multimerization Domain (SEQ ID NO) | Moiety (SEQ ID NO) |
| PD-L1 303 – ZZ12.6: PD-L1 303_3 × G4S_ ZZ12.6_Flag_His | 3555 | 3511 | — | PD-L1 IgV: D43G/N45D/ L56Q/V58A/ G101G-ins (G101GG) (303) | 3 × G4S (239) | ZZ12.6 (3505) | Flag (2010) His (2011) |

Nucleic acid molecule encoding the immunomodulatory proteins also contained residues encoding the exemplary signal peptide MGSTAILALLLAVLQGVSA (set forth in SEQ ID NO: 186). Expression constructs encoding Fc fusion proteins of interest were transiently expressed in Expi293 HEK293 cells (e.g. Invitrogen) with Expifectamine™ reagents and media following the manufacture'r instructions. Supernatants were harvested and protein was captured and eluted from a Protein A column using an AKTA protein purification system. The eluted material was then separated by an additional preparative SEC step to generate non-aggregated (monomeric), highly purified material. This material was buffer exchanged into 10 mM Acetate, 9% Sucrose, pH 5.0. (A5Su) The protein was vialed in a sterile biosafety cabinet and frozen at −80 C. A vial was thawed and assessed by analytical SEC to demonstrate the material was stable and predominantly non-aggregated (monomeric) after thaw.

B. Monomeric Configurations

In some configurations, the generated multi-domain immunomodulatory proteins were generated as monomeric molecules containing an ARBM and an IRBM linked together with a peptide linker. Exemplary linkers used in the generated proteins included GSGGS (SEQ ID NO: 2523), GGGGS (G4S; SEQ ID NO: 1942), GSGGGGS (SEQ ID NO: 1941), GGGGSGGGGS (2×GGGGS; SEQ ID NO: 240), GGGGSGGGGSGGGGS (3×GGGGS; SEQ ID NO: 239), GGGGSSA (SEQ ID NO: 2524), or any combinations thereof. In some cases, the monomeric immunomodulatory proteins also contained an N- or C-terminal moiety for detection and/or purification, such as a poly-histidine tag (HHHHHH; SEQ ID NO:2011) and/or a flag-tag (DYKDDDDK; SEQ ID NO: 2010). Nucleic acid molecules encoding the monomeric immunomodulatory proteins also contained residues encoding the exemplary signal peptide MGSTAILALLLAVLQGVSA (set forth in SEQ ID NO: 186).

Table E5 describes exemplary generated multi-domain immunomodulatory monomeric proteins.

TABLE E5

| Monomeric Multi-Domain Immunomodulatory Proteins | | | | | | |
|---|---|---|---|---|---|---|
| Description | DNA SEQ ID NO | Protein SEQ ID NO | ARBM (SEQ ID NO) | IRBM (SEQ ID NO) | Linker (SEQ ID NO) | Moiety (SEQ ID NO) |
| PD-L1/PD-L2 vIgD and OKT3 scFv | | | | | | |
| OKT3 – PD-L1 303: OKT3_GSGGS_2 × G4S_ PD-L1 303 IgV_Flag_His | 2562 | 2563 | OKT3 scFv (2522) | PD-L1 IgV: D43G/N45D/ L56Q/V58A/ G101G-ins (G101GG) (303) | GSGGS (2523) 2 × G4S (240) | Flag (2010) His (2011) |
| OKT3 – PD-L2 1417: OKT3_GSGGS_2 × G4S_ PD-L2 variant IgV_Flag_His | 2564 | 2565 | OKT3 scFv (2522) | PD-L2 IgV: H15Q/T47A/ K65R/S67L/ Q82R/V89D (1417) | GSGGS (2523) 2 × G4S (240) | Flag (2010) His (2011) |
| PD-L1 303 – OKT3: PD-L1 variant IgV_GSGGS_2 × G4S_ OKT3 scFv_Flag_His | 2566 | 2567 | OKT3 scFv (2522) | PD-L1 IgV: D43G/N45D/ L56Q/V58A/ G101G-ins (G101GG) (303) | GSGGS (2523) 2 × G4S (240) | Flag (2010) His (2011) |
| PD-L2 1417 – OKT3: PD-L2 variant IgV_GSGGS_2 × G4S_ OKT3 scFv_Flag_His | 2568 | 2569 | OKT3 scFv (2522) | PD-L2 IgV: H15Q/T47A/ K65R/S67L/ Q82R/V89D (1417) | GSGGS (2523) 2 × G4S (240) | Flag (2010) His (2011) |
| PD-L1/PD-L2 vIgD and IL16 ECD | | | | | | |
| PD-L1 303 – IL16: PD-L1 303_GSGGS_ | 2570 | 2571 | IL16 (2521) | PD-L1 IgV: D43G/N45D/ | GSGGS (2523) | Flag (2010) |

TABLE E5-continued

| Description | DNA SEQ ID NO | Protein SEQ ID NO | ARBM (SEQ ID NO) | IRBM (SEQ ID NO) | Linker (SEQ ID NO) | Moiety (SEQ ID NO) |
|---|---|---|---|---|---|---|
| Monomeric Multi-Domain Immunomodulatory Proteins | | | | | | |
| 2 × G4S_IL 16_Flag_His | | | | L56Q/V58A/ G101G-ins (G101GG) (303) | 2 × G4S (240) | His (2011) |
| IL16-PD-L1 303: IL16_GSGGS_2 × G4S_ PD-L1 303_Flag_His | 2572 | 2573 | IL16 (2521) | PD-L1 IgV: D43G/N45D/ L56Q/V58A/ G101G-ins (G101GG) (303) | GSGGS (2523) 2 × G4S (240) | Flag (2010) His (2011) |
| PD-L2 1417 − IL16: PD-L2 1417_GSGGS_ 2 × G4S_IL16_Flag_His | 2574 | 2575 | IL16 (2521) | PD-L2 IgV: H15Q/T47A/ K65R/S67L/ Q82R/V89D (1417) | GSGGS (2523) 2 × G4S (240) | Flag (2010) His (2011) |
| IL16 − PD-L2 1417: IL16_GSGGS_2 × G4S_ PD-L2 1417_Flag_His | 2576 | 2577 | IL16 (2521) | PD-L2 IgV: H15Q/T47A/ K65R/S67L/ Q82R/V89D (1417) | GSGGS (2523) 2 × G4S (240) | Flag (2010) His (2011) |
| PD-L1/PD-L2 IgV and ICOSL IgV | | | | | | |
| PD-L2 1417 − ICOSL 2247: PD-L2 1417_GSGGS_ 2 × G4S_ICOSL 2247_Flag_His | 2578 | 2579 | ICOSL IgV: N52D (2247) | PD-L2 IgV: H15Q/T47A/ K65R/S67L/ Q82R/V89D (1417) | GSGGS (2523) 2 × G4S (240) | Flag (2010) His (2011) |
| ICOSL 2247 − PD-L2 1417: ICOSL 2247_GSGGS_ 2 × G4S_PD-L2 1417_Flag_His | 2580 | 2581 | ICOSL IgV: N52D (2247) | PD-L2 IgV: H15Q/T47A/ K65R/S67L/ Q82R/V89D (1417) | GSGGS (2523) 2 × G4S (240) | Flag (2010) His (2011) |
| PD-L2 1417 − ICOSL 2266: PD-L2 1417_GSGGS_ 2 × G4S_ICOSL 2266_ Flag_His | 2582 | 2583 | ICOSL IgV: N52H/ Q100R (2266) | PD-L2 IgV: H15Q/T47A/ K65R/S67L/ Q82R/V89D (1417) | GSGGS (2523) 2 × G4S (240) | Flag (2010) His (2011) |
| ICOSL 2266 − PD-L2 1417: ICOSL 2266_GSGGS_ 2 × G4S_PD-L2 1417_Flag_His | 2584 | 2585 | ICOSL IgV: N52H/ Q100R (2266) | PD-L2 IgV: H15Q/T47A/ K65R/S67L/ Q82R/V89D (1417) | GSGGS (2523) 2 × G4S (240) | Flag (2010) His (2011) |
| PD-L2 1417 − ICOSL 2264: PD-L2 1417_GSGGS_ 2 × G4S_ICOSL 2264_Flag_His | 2586 | 2587 | ICOSL IgV: N52H/ N57Y/ Q100R (2264) | PD-L2 IgV: H15Q/T47A/ K65R/S67L/ Q82R/V89D (1417) | GSGGS (2523) 2 × G4S (240) | Flag (2010) His (2011) |
| ICOSL 2264 − PD-L2 1417: ICOSL 2264_GSGGS_ 2 × G4S_PD-L2 1417_Flag_His | 2588 | 2589 | ICOSL IgV: N52H/ N57Y/ Q100R (2264) | PD-L2 IgV: H15Q/T47A/ K65R/S67L/ Q82R/V89D (1417) | GSGGS (2523) 2 × G4S (240) | Flag (2010) His (2011) |
| PD-L2 1417 − ICOSL 2244: PD-L2 1417_GSGGS_ 2 × G4S_ICOSL 2244_Flag_His | 2590 | 2591 | ICOSL IgV: wildtype (2244) | PD-L2 IgV: H15Q/T47A/ K65R/S67L/ Q82R/V89D (1417) | GSGGS (2523) 2 × G4S (240) | Flag (2010) His (2011) |
| ICOSL 2244 − PD-L2 1417: ICOSL 2244_GSGGS_ 2 × G4S_PD-L2 1417_Flag_His | 2592 | 2593 | ICOSL IgV: wildtype (2244) | PD-L2 IgV: H15Q/T47A/ K65R/S67L/ Q82R/V89D (1417) | GSGGS (2523) 2 × G4S (240) | Flag (2010) His (2011) |
| PD-L1 303 − ICOSL 2247: PD-L1 303_GSGGS_ 2 × G4S_ICOSL 2247_Flag_His | 2594 | 2595 | ICOSL IgV: N52D (2247) | PD-L1 IgV: D43G/N45D/ L56Q/V58A/ G101G-ins (G101GG) (303) | GSGGS (2523) 2 × G4S (240) | Flag (2010) His (2011) |
| ICOSL 2247 − PD-L1 303: ICOSL 2247_GSGGS_ 2 × G4S_PD-L1 303_Flag_His | 2596 | 2597 | ICOSL IgV: N52D (2247) | PD-L1 IgV: D43G/N45D/ L56Q/V58A/ G101G-ins (G101GG) (303) | GSGGS (2523) 2 × G4S (240) | Flag (2010) His (2011) |

TABLE E5-continued

Monomeric Multi-Domain Immunomodulatory Proteins

| Description | DNA SEQ ID NO | Protein SEQ ID NO | ARBM (SEQ ID NO) | IRBM (SEQ ID NO) | Linker (SEQ ID NO) | Moiety (SEQ ID NO) |
|---|---|---|---|---|---|---|
| PD-L1 303 – ICOSL 2266: PD-L1 303_GSGGS_ 2 × G4S_ICOSL 2266_Flag_His | 2598 | 2599 | ICOSL IgV: N52H/ Q100R (2266) | PD-L1 IgV: D43G/N45D/ L56Q/V58A/ G101G-ins (G101GG) (303) | GSGGS (2523) 2 × G4S (240) | Flag (2010) His (2011) |
| ICOSL 2266 – PD-L1 303: ICOSL 2266_GSGGS_ 2 × G4S_PD-L1 303_Flag_His | 2600 | 2601 | ICOSL IgV: N52H/ Q100R (2266) | PD-L1 IgV: D43G/N45D/ L56Q/V58A/ G101G-ins (G101GG) (303) | GSGGS (2523) 2 × G4S (240) | Flag (2010) His (2011) |
| PD-L1 303 – ICOSL 2264: PD-L1 303_GSGGS_ 2 × G4S_ICOSL 2264_Flag_His | 2602 | 2603 | ICOSL IgV: N52H/ N57Y/ Q100R (2264) | PD-L1 IgV: D43G/N45D/ L56Q/V58A/ G101G-ins (G101GG) (303) | GSGGS (2523) 2 × G4S (240) | Flag (2010) His (2011) |
| ICOSL 2264 – PD-L1 303: ICOSL 2264_GSGGS_ 2 × G4S_PD-L1 303_Flag_His | 2604 | 2605 | ICOSL IgV: N52H/ N57Y/ Q100R (2264) | PD-L1 IgV: D43G/N45D/ L56Q/V58A/ G101G-ins (G101GG) (303) | GSGGS (2523) 2 × G4S (240) | Flag (2010) His (2011) |
| PD-L1 303 – ICOSL 2244: PD-L1 303_GSGGS_ 2 × G4S_ICOSL 2244_Flag_His | 2606 | 2607 | ICOSL IgV: wildtype (2244) | PD-L1 IgV: D43G/N45D/ L56Q/V58A/ G101G-ins (G101GG) (303) | GSGGS (2523) 2 × G4S (240) | Flag (2010) His (2011) |
| ICOSL 2244 – PD-L1 303: ICOSL 2244_GSGGS_ 2 × G4S_PD-L1 303_Flag_His | 2608 | 2609 | ICOSL IgV: wildtype (2244) | PD-L1 IgV: D43G/N45D/ L56Q/V58A/ G101G-ins (G101GG) (303) | GSGGS (2523) 2 × G4S (240) | Flag (2010) His (2011) |
| PD-L1 303 – ICOSL 2264: PD-L1 303_GSGGS_ 2 × G4S_ICOSL 2264_Flag_His | 3543 | 3496 | ICOSL IgV: N52H/ N57Y/ Q100R (2264) | PD-L1 IgV: D43G/N45D/ L56Q/V58A/ G101G-ins (G101GG) (303) | GSGGS (2523) 2 × G4S (240) | Flag (2010) His (2011) |
| PD-L1 303 – ICOSL 2266: PD-L1 303_GSGGS_ 2 × G4S_ICOSL 2266_Flag_His | 3544 | 3497 | ICOSL IgV: N52H/ Q100R (2266) | PD-L1 IgV: D43G/N45D/ L56Q/V58A/ G101G-ins (G101GG) (303) | GSGGS (2523) 2 × G4S (240) | Flag (2010) His (2011) |
| PD-L2 1417 – ICOSL 2266: PD-L2 1417_GSGGS_ 2 × G4S_ICOSL 2266_Flag_His | 3545 | 3498 | ICOSL IgV: N52H/ Q100R (2266) | PD-L2 IgV: H15Q/T47A/ K65R/S67L/ Q82R/V89D (1417) | GSGGS (2523) 2 × G4S (240) | Flag (2010) His (2011) |
| PD-L2 1417 – ICOSL 2264: PD-L2 1417_GSGGS_ 2 × G4S_ICOSL 2264_Flag_His | 3546 | 3499 | ICOSL IgV: N52H/ N57Y/ Q100R (2264) | PD-L2 IgV: H15Q/T47A/ K65R/S67L/ Q82R/V89D (1417) | GSGGS (2523) 2 × G4S (240) | Flag (2010) His (2011) |
| PD-L1 303 – PD-L1 303 – ICOSL 2264 – ICOSL 2264: PD-L1 303_3 × G4S_ PD-L1 303_3 × G4S_ COSL 2264_ GSGGS_2 × G4S_ ICOSL 2264_Flag_His | 3547 | 3500 | ICOSL IgV: N52H/ N57Y/ Q100R (2264) | PD-L1 IgV: D43G/N45D/ L56Q/V58A/ G101G-ins (G101GG) (303) | 3 × G4S (239) GSGGS (2523) 2 × G4S (240) | Flag (2010) His (2011) |
| PD-L1 303 – ICOSL 2264 – PD-L1 303: PD-L1 303_3 × G4S_ ICOSL 2264_3 × G4S_ PD-L1 303_Flag_His | 3548 | 3501 | ICOSL IgV: N52H/ N57Y/ Q100R (2264) | PD-L1 IgV: D43G/N45D/ L56Q/V58A/ G101G-ins (G101GG) (303) | 3 × G4S (239) GSGGS (2523) 2 × G4S (240) | Flag (2010) His (2011) |
| PD-L1 303 – | 3549 | 3502 | ICOSL IgV: | PD-L1 IgV: | 3 × G4S | Flag |

TABLE E5-continued

| Description | DNA SEQ ID NO | Protein SEQ ID NO | ARBM (SEQ ID NO) | IRBM (SEQ ID NO) | Linker (SEQ ID NO) | Moiety (SEQ ID NO) |
|---|---|---|---|---|---|---|
| Monomeric Multi-Domain Immunomodulatory Proteins | | | | | | |
| ICOSL 2264 – ICOSL 2264 – PD-L1 303: PD-L1 303_3 × G4S_ ICOSL 2264_3 × G4S_ ICOSL 2264_GSGGS_ 2 × G4S_PD-L1 303_Flag_His | | | N52H/ N57Y/ Q100R (2264) | D43G/N45D/ L56Q/V58A/ G101G-ins (G101GG) (303) | (239) GSGGS (2523) 2 × G4S (240) | (2010) His (2011) |
| PD-L1 303 – ICOSL 2244: PD-L1 303_GSGGS_ 2 × G4S_ICOSL 2244_Flag_His | 3578 | 3535 | ICOSL IgV: wildtype (2244) | PD-L1 IgV: D43G/N45D/ L56Q/V58A/ G101G-ins (G101GG) (303) | GSGGS (2523) 2 × G4S (240) | Flag (2010) His (2011) |
| PD-L1/PD-L2 IgV and CD80/CD86 IgV | | | | | | |
| PD-L2 1417 – CD86 2610: PD-L2 1417_GSGGS_ 2 × G4S_CD86 2610_Flag_His | 2611 | 2612 | CD86 IgV: wildtype (2610) | PD-L2 IgV: H15Q/T47A/ K65R/S67L/ Q82R/V89D (1417) | GSGGS (2523) 2 × G4S (240) | Flag (2010) His (2011) |
| CD86 2610 – PD-L2 1417: CD86 2610_GSGGS_ 2 × G4S_PD-L2 1417_Flag_His | 2613 | 2614 | CD86 IgV: wildtype (2610) | PD-L2 IgV: H15Q/T47A/ K65R/S67L/ Q82R/V89D (1417) | GSGGS (2523) 2 × G4S (240) | Flag (2010) His (2011) |
| PD-L2 1417 – CD80 2615: PD-L2 1417_GSGGS_ 2 × G4S_CD80 2615_Flag_His | 2618 | 2619 | CD80 IgV: wildtype (2615) | PD-L2 IgV: H15Q/T47A/ K65R/S67L/ Q82R/V89D (1417) | GSGGS (2523) 2 × G4S (240) | Flag (2010) His (2011) |
| CD80 2615 – PD-L2 1417: CD80 2615_GSGGS_ 2 × G4S_PD-L2 1417_Flag_His | 2620 | 2621 | CD80 IgV: wildtype (2615) | PD-L2 IgV: H15Q/T47A/ K65R/S67L/ Q82R/V89D (1417) | GSGGS (2523) 2 × G4S (240) | Flag (2010) His (2011) |
| PD-L2 1417 – CD80 2616: PD-L2 1417_GSGGS_ 2 × G4S_CD80 2616_Flag_His | 2622 | 2623 | CD80 IgV: V22L/E35G/ A71D/L72P (2616) | PD-L2 IgV: H15Q/T47A/ K65R/S67L/ Q82R/V89D (1417) | GSGGS (2523) 2 × G4S (240) | Flag (2010) His (2011) |
| CD80 2616 – PD-L2 1417: CD80 2616_GSGGS_ 2 × G4S_PD-L2 1417_Flag_His | 2624 | 2625 | CD80 IgV: V22L/E35G/ A71D/L72P (2616) | PD-L2 IgV: H15Q/T47A/ K65R/S67L/ Q82R/V89D (1417) | GSGGS (2523) 2 × G4S (240) | Flag (2010) His (2011) |
| PD-L2 1417 – CD80 2617: PD-L2 1417_GSGGS_ 2 × G4S_CD80 2617_Flag_His | 2626 | 2627 | CD80 IgV: E35G/K54E/ A71D/L72P (2617) | PD-L2 IgV: H15Q/T47A/ K65R/S67L/ Q82R/V89D (1417) | GSGGS (2523) 2 × G4S (240) | Flag (2010) His (2011) |
| CD80 2617 – PD-L2 1417: CD80 2617_GSGGS_ 2 × G4S_PD-L2 1417_Flag_His | 2628 | 2629 | CD80 IgV: E35G/K54E/ A71D/L72P (2617) | PD-L2 IgV: H15Q/T47A/ K65R/S67L/ Q82R/V89D (1417) | GSGGS (2523) 2 × G4S (240) | Flag (2010) His (2011) |
| PD-L1 303 – CD86 2610: PD-L1 303_GSGGS_ 2 × G4S_CD86 2610_Flag_His | 2630 | 2631 | CD86 IgV: wildtype (2610) | PD-L1 IgV: D43G/N45D/ L56Q/V58A/ G101G-ins (G101GG) (303) | GSGGS (2523) 2 × G4S (240) | Flag (2010) His (2011) |
| CD86 2610 – PD-L1 303: CD86 2610_GSGGS_ 2 × G4S_PD-L1 303_Flag_His | 2632 | 2633 | CD86 IgV: wildtype (2610) | PD-L1 IgV: D43G/N45D/ L56Q/V58A/ G101G-ins (G101GG) (303) | GSGGS (2523) 2 × G4S (240) | Flag (2010) His (2011) |
| PD-L1 303 – CD80 2615: PD-L1 303_GSGGS_ 2 × G4S_CD80 2615_Flag_His | 2634 | 2635 | CD80 IgV: wildtype (2615) | PD-L1 IgV: D43G/N45D/ L56Q/V58A/ G101G-ins (G101GG) (303) | GSGGS (2523) 2 × G4S (240) | Flag (2010) His (2011) |

TABLE E5-continued

| Description | DNA SEQ ID NO | Protein SEQ ID NO | ARBM (SEQ ID NO) | IRBM (SEQ ID NO) | Linker (SEQ ID NO) | Moiety (SEQ ID NO) |
|---|---|---|---|---|---|---|
| Monomeric Multi-Domain Immunomodulatory Proteins | | | | | | |
| CD80 2615 – PD-L1 303: CD80 2615_GSGGS_ 2 × G4S_PD-L1 303_Flag_His | 2636 | 2637 | CD80 IgV: wildtype (2615) | PD-L1 IgV: D43G/N45D/ L56Q/V58A/ G101G-ins (G101GG) (303) | GSGGS (2523) 2 × G4S (240) | Flag (2010) His (2011) |
| PD-L1 303 – CD80 2616: PD-L1 303_GSGGS_ 2 × G4S_CD80 2616_Flag_His | 2638 | 2639 | CD80 IgV: V22L/E35G/ A71D/L72P (2616) | PD-L1 IgV: D43G/N45D/ L56Q/V58A/ G101G-ins (G101GG) (303) | GSGGS (2523) 2 × G4S (240) | Flag (2010) His (2011) |
| CD80 2616 – PD-L1 303: CD80 2616_GSGGS_ 2 × G4S_PD-L1 303_Flag_His | 2640 | 2641 | CD80 IgV: V22L/E35G/ A71D/L72P (2616) | PD-L1 IgV: D43G/N45D/ L56Q/V58A/ G101G-ins (G101GG) (303) | GSGGS (2523) 2 × G4S (240) | Flag (2010) His (2011) |
| PD-L1 303 – CD80 2617: PD-L1 303_GSGGS_ 2 × G4S_CD80 2617_Flag_His | 2642 | 2643 | CD80 IgV: E35G/K54E/ A71D/L72P (2617) | PD-L1 IgV: D43G/N45D/ L56Q/V58A/ G101G-ins (G101GG) (303) | GSGGS (2523) 2 × G4S (240) | Flag (2010) His (2011) |
| CD80 2617 – PD-L1 303: CD80 2617_GSGGS_ 2 × G4S_PD-L1 303_Flag_His | 2644 | 2645 | CD80 IgV: E35G/K54E/ A71D/L72P (2617) | PD-L1 IgV: D43G/N45D/ L56Q/V58A/ G101G-ins (G101GG) (303) | GSGGS (2523) 2 × G4S (240) | Flag (2010) His (2011) |
| PD-L1/PD-L2 IgV and CTLA-4 ECD | | | | | | |
| CTLA-4 2520 – PD-L1 303: CTLA-4 2519_GSGGS_ 2 × G4S_PD-L1 303_Flag_His | 2646 | 2647 | CTLA-4 ECD: A31Y/L106E (2520) | PD-L1 IgV: D43G/N45D/ L56Q/V58A/ G101G-ins (G101GG) (303) | GSGGS (2523) 2 × G4S (240) | Flag (2010) His (2011) |
| CTLA-4 2520 – PD-L2 1417: CTLA-4 2520 _GSGGS_ 2 × G4S_PD-L2 1417_ Flag_His | 2648 | 2649 | CTLA-4 ECD: A31Y/L106E (2520) | PD-L2 IgV: H15Q/T47A/ K65R/S67L/ Q82R/V89D (1417) | GSGGS (2523) 2 × G4S (240) | Flag (2010) His (2011) |
| PD-L1 303 – CTLA-4 2520: PD-L1 303_GSGGS_ 2 × G4S_CTLA-4 2520_Flag_His | 2650 | 2651 | CTLA-4 ECD: A31Y/L106E (2520) | PD-L1 IgV: D43G/N45D/ L56Q/V58A/ G101G-ins (G101GG) (303) | GSGGS (2523) 2 × G4S (240) | Flag (2010) His (2011) |
| PD-L2 1417 – CTLA-4 2520: PD-L2 1417_GSGGS_ 2 × G4S_CTLA-4 2520_Flag_His | 2652 | 2653 | CTLA-4 ECD: A31Y/L106E (2520) | PD-L2 IgV: H15Q/T47A/ K65R/S67L/ Q82R/V89D (1417) | GSGGS (2523) 2 × G4S (240) | Flag (2010) His (2011) |
| PD-L1/L2 and CD58 IgV | | | | | | |
| PD-L1 303 – PD-L1 303 – CD58 3650 – CD58 3650 PD-L1 303_3XG4S_ PD-L1 303_3XG4S_ CD58 3650_3XG4S_ CD58 3650_GSG4S_ FLAG_His6 | 3683 | 3684 | CD58 wild-type (3650) | PD-L1 IgV: D43G/N45D/ L56Q/V58A/ G101G-ins (G101GG) (303) | 3XG4S (239) GSG4S (1941) | Flag (2010) His (2011) |
| CD58 3650 – CD58 3650 – PD-L1 303 – PD-L1 303 CD58 3650_ 3XG4S_CD58 3650 3XG4S_PD-L1 303 3XG4S_PD-L1 303 | 3685 | 3686 | CD58 wild-type (3650) | PD-L1 IgV: D43G/N45D/ L56Q/V58A/ G101G-ins (G101GG) (303) | 3XG4S (239) GSG4S (1941) | Flag (2010) His (2011) |

TABLE E5-continued

| Monomeric Multi-Domain Immunomodulatory Proteins | | | | | | |
|---|---|---|---|---|---|---|
| Description | DNA SEQ ID NO | Protein SEQ ID NO | ARBM (SEQ ID NO) | IRBM (SEQ ID NO) | Linker (SEQ ID NO) | Moiety (SEQ ID NO) |
| GSG4S_FLAG_His6 | | | | | | Flag (2010) His (2011) |
| CD58 3650 – PD-L1 303 – PD-L1 303 – CD58 3650_ CD58 3650_3XG4S_ PD-L1 303_3XG4S_ PD-L1 303_3XG4S_ CD58_GSG4S_ FLAG_His6 | 3687 | 3688 | CD58 wild-type (3650) | PD-L1 IgV: D43G/N45D/ L56Q/V58A/ G101G-ins (G101GG) (303) | 3XG4S (239) GSG4S (1941) | Flag (2010) His (2011) |
| CD155 IgV and ICOSL IgV | | | | | | |
| CD155 665 – CD155 665 – ICOSL 2264 – ICOSL 2264 CD155 665_3XG4S_CD155 665_3XG4S_ICOSL 2264_3XG4S_ICOSL 2264_G4S_Flag_His | 3655 | 3656 | ICOSL IgV: N52H/ N57Y/ Q100R (2264) | CD155 IgV: P18S/S65W/ S67A/M90V/ V95A/L104Q/ G111R (665) | 3XG4S (1942) G4S (239) | Flag (2011) His (2010) |
| CD155 665 – ICOSL 2264 – ICOSL 2264 – CD155 665 CD155 665_3XG4S_ICOSL 2264_3XG4S_ICOSL 2264_3XG4S_CD155 2265_G4S_Flag_His | 3657 | 3658 | ICOSL IgV: N52H/ N57Y/ Q100R (2264) | CD155 IgV: P18S/S65W/ S67A/M90V/ V95A/L104Q/ G111R (665) | 3XG4S (1942) G4S (239) | Flag (2011) His (2010) |
| Reference | | | | | | |
| PD-L1 303: PD-L1 303_ Flag_His | 3568 | 3525 | — | PD-L1 IgV: D43G/N45D/ L56Q/V58A/ G101G-ins (G101GG) (303) | — | Flag (2011) His (2010) |
| PD-L2 1417: PD-L2 1417_GS_ Flag_GS_His | 3569 | 3526 | — | PD-L2 IgV: H15Q/T47A/ K65R/S67L/ Q82R/V89D (1417) | GS | Flag (2010) His (2011) |
| ICOSL 2266: ICOSL 2266_ Flag_His | 3570 | 3527 | ICOSL IgV: N52H/ Q100R (2266) | — | — | Flag (2010) His (2011) |
| ICOSL 2264: ICOSL 2264_ Flag_His | 3571 | 3528 | ICOSL IgV: N52H/ N57Y/ Q100R (2264) | — | — | Flag (2010) His (2011) |

Example 2

Assessment of Binding of Multi-Domain Immunomodulatory Proteins to Binding Partners This Example describes binding studies of purified proteins generated as described in Example 1 to assess specificity and affinity of various multi-domain immunomodulatory proteins for two different binding partners. Binding studies were carried out on cells transfected with relevant binding partners of the IRBM or ARBM of the multi-domain molecules.

For staining by flow cytometry, 100,000 cells expressing the various cell-expressed binding partners were plated in 96-well round-bottom plates. Cells were spun down and resuspended in staining buffer (PBS (phosphate buffered saline), 1% BSA (bovine serum albumin), 1 mM EDTA, and 0.1% sodium azide) for 20 minutes to block non-specific binding. Afterwards, cells were centrifuged again and resuspended in 50 μL staining buffer containing 100 nM of molecules containing exemplary multi-domain immunomodulatory proteins. As a control, binding was assessed on 100 nM of respective individual ARBM and IRBM molecules.

Primary staining was performed on ice for 45 minutes, before washing cells twice in 200 μL staining buffer. PE-conjugated anti-human Fc (Jackson ImmunoResearch, USA) or PE-conjugated anti-FLAG (BioLegend, USA) was diluted 1:150 in 50 μL staining buffer and added to cells and incubated another 30 minutes on ice. Secondary antibody was washed out twice, cells were fixed in 4% formaldehyde/PBS, and samples were analyzed on Intellicyt flow cytometer (Intellicyt Corp., USA). Mean Fluorescence Intensity (MFI) was calculated with FlowJo Version 10 software (FlowJo LLC, USA).

A. PD-L1/PD-L2 and IL16/CTLA-4/OKT3 Molecules

Binding studies were carried out on 100,000 CHO cells stably transduced with PD-1 (CHO/PD-1 cells) or K562 cells stably transduced with CD80 (K562/CD80) or were carried out using Jurkat cells (human acute T cell lymphoma cells, Promega Corp., USA) which endogenously express CD4, CD28 and T cell receptor. The following control immunomodulatory proteins were assessed: (1) variant PD-L1 IgV-Fc (D43G/N45D/L56Q/V58A/G101G-ins (G101GG) (SEQ ID NO:303), (2) variant PD-L2 IgV-Fc (H15Q/T47A/K65R/S67L/Q82R/V89D) (SEQ ID NO:1417); (3) variant CTLA-4-Fc (A31Y/L106E) (SEQ ID NO:2519 or 2520), (4) anti-PD-1 antibody Nivolumab, or (5) Fc only control.

Table E6 and E7 set forth the binding activity as measured by the Mean Fluorescence Intensity (MFI) value for binding of 100 nM of each immunomodulatory protein tested to cells expressing the various cell-expressed counter structures. As shown in Table E6 and E7, several immunomodulatory proteins bound multiple binding partners including PD-1 and CD28, CD4, and/or CD80.

TABLE E6

Binding of Exemplary Immunomodulatory Proteins to Cell-Expressed Counter Structures

| Description | SEQ ID NO | Detection | PD1 Binding (100 nM) | CD28 Binding (100 nM) | CD4 Binding (100 nM) | CD80 Binding (100 nM) |
|---|---|---|---|---|---|---|
| PD-L1 303 - IL16 | 2571 | Anti- | 59805 | — | 26.3 | 97 |
| IL16 - PD-L1 303 | 2572 | FLAG-PE | 1098 | — | 25.6 | 94 |
| PD-L2 1417 - IL16 | 2574 | MFI | 19852 | — | 26.3 | 87 |
| IL16 - PD-L2 1417 | 2576 | | 130 | — | 35.5 | 118 |
| CTLA-4 2520 - PD-L1 303 | 2646 | Anti- | 158 | — | 25.1 | 35872 |
| CTLA-4 2520 - PD-L2 1417 | 2648 | FLAG-PE | 115 | — | 25.1 | 17715 |
| PD-L1 303 - CTLA-4 2520 | 2650 | MFI | 14224 | — | 25.7 | 13493 |
| PD-L2 1417 - CTLA-4 2520 | 2652 | | 2417 | — | 2531 | 11776 |
| CTLA-4 2520 - PD-L1 303 - Fc | 2533 | Anti-hFc- | — | — | — | — |
| CTLA-4 2520 - PD-L2 1417 - Fc | 2535 | PE MFI | — | — | — | — |
| PD-L1 303 - CTLA-4 2519 - Fc | 2537 | | 143069 | 161 | — | 174745 |
| PD-L2 1417 - Fc - CTLA-4 2520 | 2543 | | 261417 | 28 | — | 164843 |

TABLE E7

Binding of Exemplary Immunomodulatory Proteins to Cell-Expressed Counter Structures

| Description | SEQ ID NO | Detection | PD1 Binding (100 nM) | CD28 Binding (100 nM) | CD4 Binding (100 nM) | CD80 Binding (100 nM) |
|---|---|---|---|---|---|---|
| CTLA-4 2519 - PD-L1 303 - PD-L1 303 - PD-L1 303 - Fc | 2531 | Anti-hFc- PE MFI | 12553 | 33 | — | 238519 |
| IL16 - PD-L1 303 - PD-L1 303 - PD-L1 303 - Fc | 2530 | | 13568 | 40 | — | 153 |
| Anti-CD3 - PD-L1 303 - PD-L1 303 - PD-L1 303 - Fc | 2529 | | 12007 | 3596 | — | 181 |
| PD-L1 303 - Fc | 303 (IgV only) | Anti-hFc- PE MFI | 261417 | 99 | 83.2 | 458 |
| PD-L2 1417 - Fc | 1417 (IgV only) | | 244557 | 63 | 67.2 | 179 |
| Anti-PD-1 monoclonal antibody (nivolumab) | — | | 250052 | 50 | 49.5 | 142 |
| CTLA-4 2519 - Fc | 2519 (IgV only) | | 123 | 29 | 28.3 | 261417 |
| Fc Control | 1155 | | 122 | 26 | 27.6 | 107 |

Figure 11A:
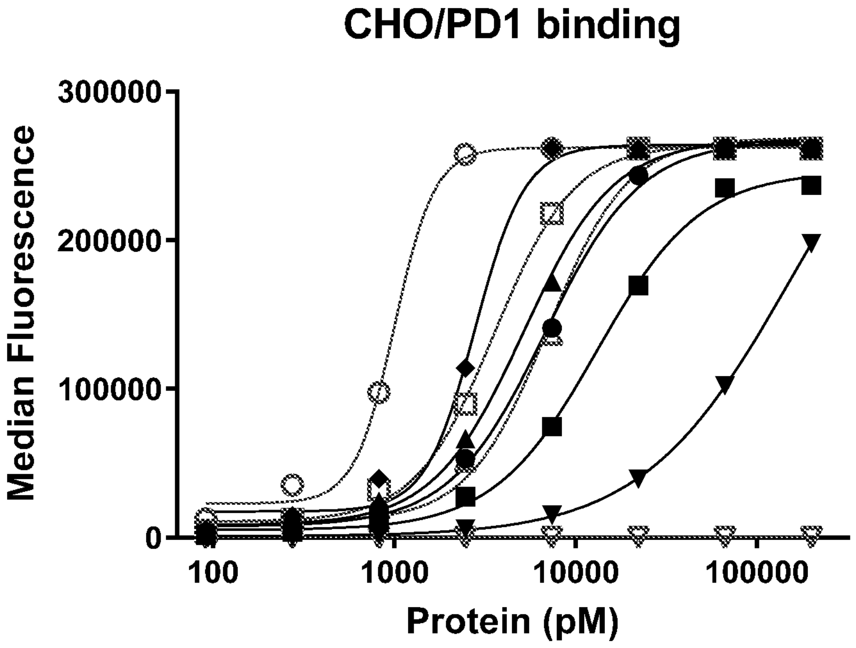
FIGS. 11A-11B show results from assessment of binding of immunomodulatory proteins containing PD-L1 IgV/PD-L2 IgV and CTLA-4 to binding partners PD-1 and/or CD80.
Figure 11B:
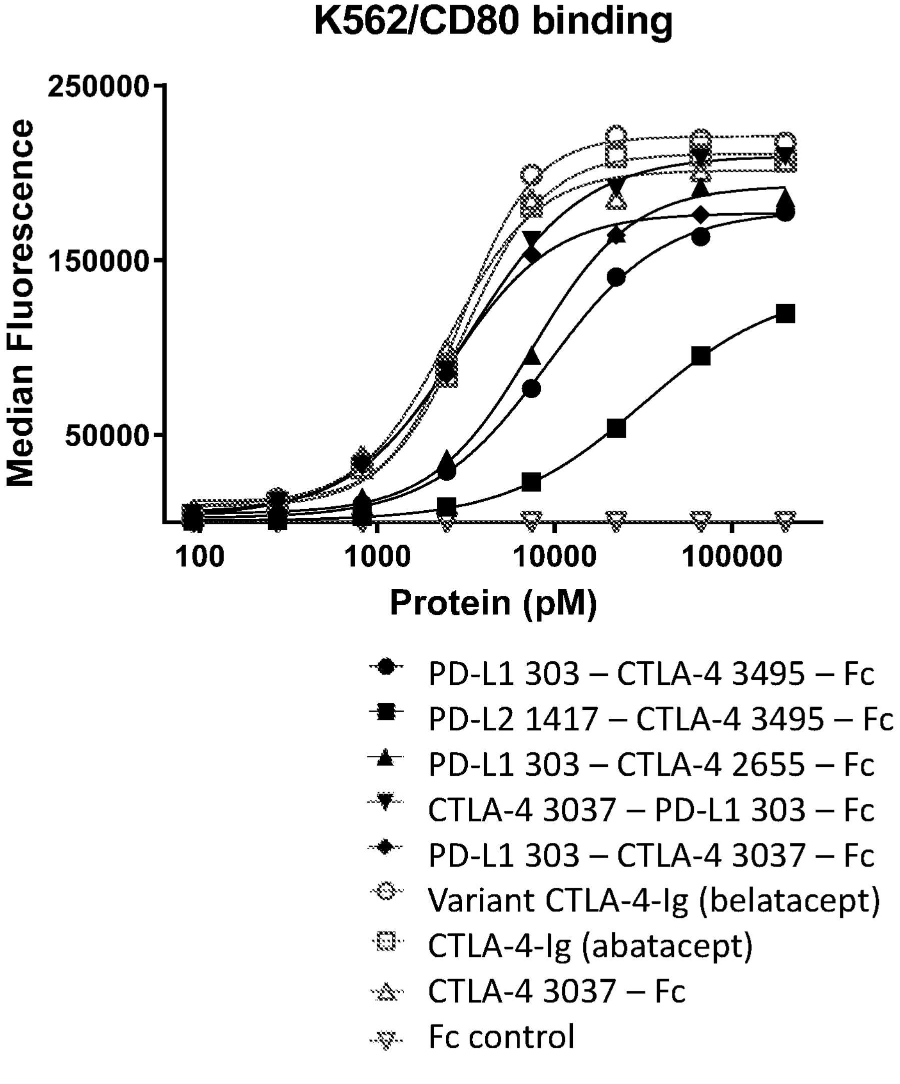

The binding of additional immunomodulatory proteins containing PD-L1 IgV/PD-L2 IgV and CTLA-4 to targets was assessed substantially as described above. In addition to the control molecules described above, a variant PD-L1 IgV-Flag-His (D43G/N45D/L56Q/V58A/G101G-ins (G101GG) (SEQ ID NO:303)) was also assessed. Exemplary multi-domain immunomodulatory proteins from Table E2 were assessed including those as set forth in SEQ ID NOs: 3518, 3519, 3521, 3522, and 3523. Binding results in FIG. 11A-11B with MFI at increasing test concentration of added protein show several immunomodulatory proteins bound binding partners including PD-1 and/or CD80.

B. PD-L1/PD-L2 and OKT3/ICOSL

CHO cells were transduced to stably express human PD-1 (CHO/PD-1 cells) or human CTLA-4 (CHO/CTLA-4). Jurkat cells were used to measure binding to endogenously expressed human T cell receptor (TCR) (Jurkat/TCR cells) and CD28 (Jurkat/CD28). To measure binding to ICOS, transiently transfected HEK293 cells were used. Proteins bound to the cell surface were detected using an anti-Flag tag PE secondary reagent.

As shown in Table E8A-E8B, a number of immunomodulatory proteins were observed to bind multiple binding partners including PD-1 and CD28, CD4, and/or CD80. Among the results shown, immunomodulatory proteins with PD-L1 IgV or PD-L2 IgV molecules at the N-terminus and ICOSL molecules at the C-terminus (PD-L1 IgV/PD-L2 IgV-ICOSL IgV) showed greater binding to PD-1 as compared to molecules generated with molecules in the reverse order (ICOSL IgV-PD-L1 IgV/PD-L2 IgV). All values reported are PE MFI at the test concentration of 100 nM. For Tables E8A-E8B, an anti-Flag-PE detection reagent was used for detecting the tested molecules.

TABLE E8A

Binding of Immunomodulatory Proteins Containing PD-L1 IgV/PD-L2 IgV - OKT3/ICOSL IgV to Cell-Expressed Counter Structures

| Description | SEQ ID NO | PD1 Binding (100 nM) | TCR Binding (100 nM) | CTLA-4 Binding (100 nM) | ICOS Binding (100 nM) |
|---|---|---|---|---|---|
| OKT3 - PD-L1 303 | 2563 | 107768 | 6535 | 85 | — |
| OKT3 - PD-L2 1417 | 2565 | 1251 | 3517 | 83.2 | — |
| PD-L1 303 - OKT3 | 2567 | 105987 | 3527 | 85 | — |
| PD-L2 1417 - OKT3 | 2569 | 43936 | 3121 | 84.6 | — |

TABLE E8B

Binding of Immunomodulatory Proteins Containing PD-L1 IgV/PD-L2 IgV - OKT3/ICOSL IgV to Cell-Expressed Counter Structures

| Description | SEQ ID NO | PD1 Binding (100 nM) | CD28 Binding (100 nM) | CTLA-4 Binding (100 nM) | ICOS Binding (100 nM) |
|---|---|---|---|---|---|
| PD-L1 303 - ICOSL 2247 | 2595 | 71242 | 155 | 85 | 22809 |
| ICOSL 2247 - PD-L1 303 | 2597 | 12870 | 373 | 90.4 | 46705 |
| PD-L1 303 - ICOSL 2266 | 2599 | 80728 | 618 | 102 | 35972 |
| ICOSL 2266 - PD-L1 303 | 2601 | 15852 | 3459 | 603 | 47888 |
| PD-L1 303 - ICOSL 2264 | 2603 | 68145 | 11678 | 18831 | 42026 |
| ICOSL 2264 - PD-L1 303 | 2605 | 9858 | 17715 | 53367 | 48423 |
| PD-L1 303 - ICOSL 2244 | 2607 | 80504 | 286 | 87.2 | 3547 |
| ICOSL 2244 - PD-L1 303 | 2609 | 17229 | 217 | 88.4 | 19201 |
| PD-L2 1417 - ICOSL 2247 | 2579 | 28884 | 116 | 87.7 | 21697 |
| ICOSL 2247 - PD-L2 1417 | 2581 | 1248 | 378 | 92.9 | 36273 |
| PD-L2 1417 - ICOSL 2266 | 2583 | 30449 | 236 | 91.7 | 40875 |
| ICOSL 2266 - PD-L2 1417 | 2585 | 1089 | 3909 | 1204 | 43693 |
| PD-L2 1417 - ICOSL 2264 | 2587 | 37088 | 10925 | 10715 | 36780 |
| ICOSL 2264 - PD-L2 1417 | 2589 | 1139 | 18264 | 53367 | 49925 |
| PD-L2 1417 - ICOSL 2244 | 2591 | 25138 | 114 | 89.2 | 3909 |
| PD-L1 303 - ICOSL 2247 | 2593 | 1319 | 246 | 88.4 | 12764 |

C. PD-L1/PD-L2-CD86/CD80

CHO cells were transduced to stably express human PD-1 (CHO/PD-1 cells) or human CTLA-4 (CHO/CTLA-4). Jurkat cells were used to measure binding to endogenously expressed human CD28 (Jurkat/CD28). To measure binding to ICOS, transiently transfected HEK293 cells were used. Proteins bound to the cell surface were detected using an anti-Flag tag PE secondary reagent. Binding results shown in Table E9A are MFI at 100 nM test concentration.

TABLE E9A

Binding of Immunomodulatory Proteins Containing PD-L1 IgV/PD-L2 IgV - CD86 IgV/CD80 IgV to Cell-Expressed Counter Structures

| Description | SEQ ID NO | PDI Binding (100 nM) | CD28 Binding (100 nM) | CTLA-4 Binding (100 nM) |
|---|---|---|---|---|
| PD-L1 303 - CD86 2610 | 2631 | 73657 | 867 | 275 |
| CD86 2610 - PD-L1 303 | 2633 | 3687 | 301 | 462 |
| PD-L2 1417 - CD86 2610 | 2612 | 12243 | 113 | 180 |
| CD86 2610 - PD-L2 1417 | 2614 | 1345 | 91.7 | 427 |
| PD-L1 303 - CD80 2615 | 2635 | 2778 | 87.7 | 89.2 |
| CD80 2615 - PD-L1 303 | 2637 | 2679 | 90.9 | 124 |
| PD-L1 303 - CD80 2616 | 2639 | 58166 | 120 | 89.6 |
| CD80 2616 - PD-L1 303 | 2641 | 40311 | 207 | 91.7 |
| PD-L1 303 - CD80 2617 | 2643 | 50343 | 103 | 85 |
| CD80 2617 - PD-L1 303 | 2645 | 30875 | 112 | 85.8 |
| PD-L2 1417 - CD80 2615 | 2619 | 1406 | 82.5 | 83.2 |
| CD80 2615 - PD-L2 1417 | 2621 | 1151 | 90.9 | 142 |
| PD-L2 1417 - CD80 2616 | 2623 | 20018 | 89.2 | 79.3 |
| CD80 2616 - PD-L2 1417 | 2625 | 1516 | 92.2 | 82.5 |
| PD-L2 1417 - CD80 2617 | 2627 | 13682 | 94.2 | 85 |
| CD80 2617 - PD-L2 1417 | 2629 | 1391 | 110 | 75.5 |
| PD-L2 1417 | 1417 | 26208 | 154 | 152 |
| Wild-type PD-L1 | 309 | 1287 | 716 | 97.4 |
| ICOSL 2264 | 2264 | 1512 | 16118 | 70848 |

D. Additional Multi-Domain Immunomodulatory Proteins

Additional multi-domain immunomodulatory proteins described in Example 1 were assessed for binding to cognate binding partners substantially as described above. Jurkat IL-2 reporter cells (described in Example 3 below) were transfected to express human PD-1 (Jurkat/IL-2/PD-1 cells) or human TIGIT (Jurkat/IL-2/TIGIT). CHO cells were transfected to express CD2 (CHO-CD2) or CD80 (CHO-CD80). Expi293 cells were transfected to express CD28 (Expi-CD28). Proteins bound to the cell surface were detected using an anti-Flag tag PE secondary reagent or an Anti-hFc-PE MFI, depending on the construct. Mean fluorescence intensity (MFI) was determined. The half maximal binding concentration (EC50; nM) was determined by nonlinear regression by fitting the data to a sigmoidal dose-response (variable slope; Hill slope=1). Results are shown in Table E9B. As shown, a number of immunomodulatory proteins were observed to bind multiple binding partners.

TABLE E9B

Binding of Exemplary Immunomodulatory Proteins to Cell-Expressed Counter Structures

| Description | SEQ ID NO | Binding: EC50 (nM) | | | | |
|---|---|---|---|---|---|---|
| | | CHO-CD2 | Expi-CD28 | CHO-CD80 | Jurkat/IL-2/PD-1 | Jurkat/IL-2/TIGIT |
| CTLA-4 3037 – PD-L1 303 – Fc | 3666 | | | 2.3 | 110.7 | |
| PD-L1 303 – CTLA-4 3037 – Fc | 3668 | | | 1.4 | 1.0 | |
| CTLA-4 3037 – Fc – PD-L1 303 | 3670 | | | 1.9 | 4.5 | |
| CTLA4 3037 – Fc – PD-L1 303 | 3672 | | | 0.921 | 6.8 | |
| CTLA-4 3060 – PD-L1 303 – Fc | 3674 | | | 2.3 | 0.6 | |
| PD-L1 303 – CTLA4 3060 – Fc | 3676 | | | 3.4 | 0.5 | |
| PD-L1 303 – 3 × G4S – ICOSL 2264 – G4S ZZ12.6 FLAG His6 | 3678 | | 19.01 | | 11.8 | |
| CD58 3650 – PD-L1 303 – Fc | 3680 | 2.0 | | | 4.6 | |

TABLE E9B-continued

Binding of Exemplary Immunomodulatory Proteins to Cell-Expressed Counter Structures

| Description | SEQ ID NO | Binding: EC50 (nM) CHO-CD2 | Expi-CD28 | CHO-CD80 | Jurkat/IL-2/PD-1 | Jurkat/IL-2/TIGIT |
|---|---|---|---|---|---|---|
| PD-L1 303 – CD58 3650 – Fc | 3682 | 0.661 | | | 1.2 | |
| PD-L1 303 – PD-L1 303 – CD58 3650 – CD58 3650 | 3684 | 13.7 | | | 2.0 | |
| CD58 3650 – CD58 3650 – PD-L1 303 – PD-L1 303 | 3686 | 24.4 | | | 19.5 | |
| CD58 3650 – PD-L1 303 – PD-L1 303 – CD58 3650 | 3688 | 14.4 | | | 6.6 | |
| CD155 665 – CD58 3650 – Fc | 3660 | 0.845 | | | | 0.733 |
| CD58 3650 - CD155 665 – Fc | 3662 | 0.935 | | | | 1.0 |
| CTLA-4 3060 – CD155 665 – Fc | 3652 | | | 1.8 | | 3.4 |
| CD 155 665 – CTLA-4 3037 – Fc | 3654 | | | 4.1 | | 0.6 |
| PD-L1 303 – CD155 665 – CTLA-4 3037 – Fc | 3664 | | 4.15 | | | 1.6 |
| CD 155 665 – ICOSL 2264 – ICOSL 2264 – CD155 665 | 3658 | | 3.39 | | | 2.3 |
| PD-L1 303 – CD155 665 – CTLA-4 3037 – Fc | 3664 | | | 3.8 | 1.3 | 1.6 |
| CD 155 665 G4S FLAGHis | CD 155 IgV (665) Flag (2010) His (2011) | | | | | |
| ICOSL 2264 IgV – Fc | ICOSL IgV (2264) Fc (1715) | | 0.254 | | | |
| CTLA4 3037 – Fc | CTLA-4 ECD (3037) Fc (1715) | | | 1.7 | | |
| Belatacept | | | | 4.1 | | |
| CD58 (WT) 3650 – Fc | CD58 WT IgV (3650) Fc (1715) | 0.200 | | | | |
| Fc control | 1715 | | | | | |

Example 3

Figure 3A:
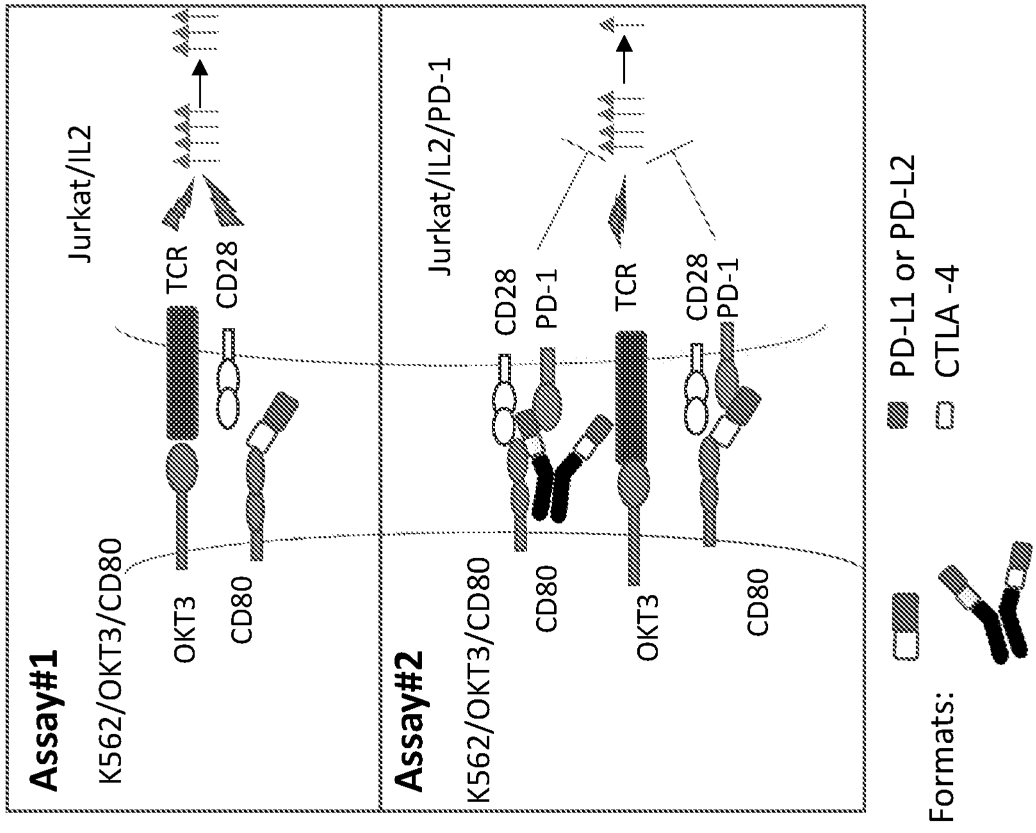
FIG. 3A depicts a reporter assay (Assay #1) used to assess activity of exemplary multi-domain immunomodulatory proteins where Jurkat reporter cells expressing an IL-2-luciferase reporter were incubated with artificial antigen presenting cells (aAPC) displaying cell surface anti-CD3 single chain Fv (OKT3) and CD80 (K562/OKT3/CD80 aAPC).
Figure 3B:
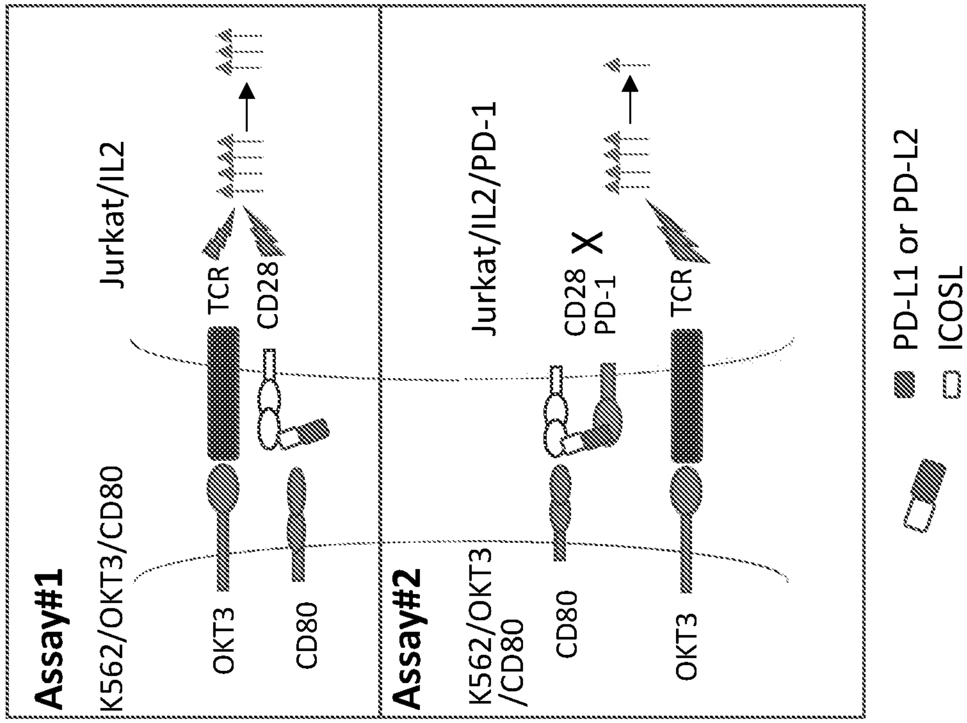
FIG. 3B depicts a reporter assay (Assay #2) used to assess activity of exemplary multi-domain immunomodulatory proteins where Jurkat reporter cells were additionally transfected with PD-1 and incubated with the K562/OKT3/CD80 aAPCs. The two assays were used to distinguish between inhibitory activity due to blockade of CD28 signaling versus inhibitory activity via activity of the PD-1-binding IRBM.

Assessment of Bioactivity of Multi-Domain Immunomodulatory Proteins Containing Activating and Inhibitory Components Using Reporter Cells This Example describes a Jurkat/IL2 and Jurkat/IL2/PD-1 reporter assay to assess inhibitory activity of exemplary multi-domain immunomodulatory proteins generated as described in Example 1. In this assay, activity was tested on multi-domain proteins containing an ARBM able to bind CD28 (e.g. CD80, CD86, CTLA-4 or ICOSL) and an IRBM able to bind to PD-1 (PD-L1 or PD-L1). To distinguish between inhibitory activity due to blockade of CD28 signaling versus inhibitory activity via activity of the PD-1-binding IRBM, two reporter cell assays were used. In the first assay, Jurkat reporter cells expressing an IL-2-luciferase reporter were incubated with artificial antigen presenting cells (aAPC) displaying cell surface anti-CD3 single chain Fv (OKT3) and CD80 (K562/OKT3/CD80 aAPC) (FIG. 3A and FIG. 3B, Assay #1). In a second assay, the Jurkat reporter cells were additionally transfected with PD-1 and incubated with the K562/OKT3/CD80 aAPCs (Assay #2 in FIGS. 3A and 3B).

For both assays, Jurkat cells were suspended at $2\times10^6$ cells/mL in RPMI1640+5% FBS and were then plated at 50 µL/well for a total of 100,000 cells per well. To each well, indicated test immunomodulatory proteins were added to the Jurkat cells at concentrations ranging from approximately 0.4 nM to 50 nM, or, in some cases, 0.4 nM to 100 nM. As a control, activity of respective individual ARBM and IRBM molecules also was assessed. The Jurkat cells with test or control proteins were incubated for 15 minutes at room temperature. K562/OKT3/CD80 aAPC were brought to $0.8\times10^6$ cells/mL and 25 µL of cells was added to each well bringing the final volume of each well to 100 µL. Jurkat cells and K562 aAPCs were incubated for 5-6 hours at 37 degrees Celsius in a humidified 5% $CO_2$ incubation chamber. Plates were then removed from the incubator and acclimated to room temperature for 15 minutes. 100 µL of a cell lysis and luciferase substrate solution (BioGlo®, Promega Corp, USA) was added to each well and the plates were placed on an orbital shaker for 10 minutes at room temperature. Luminescence was measured with a 1 second per well integration time using a BioTek Cytation luminometer (BioTek Corp., USA). An average relative luminescence value was determined for each test immunomodulatory protein or control protein.

A. PD-L1/PD-L2-CTLA-4

The assays described above were carried out on multi-domain immunomodulatory proteins, containing PD-L1/PD-L2 IgV and CTLA-4 ECD, generated as Fc fusion proteins or as monomeric proteins. Specifically, the following exemplary multi-domain immunomodulatory proteins were assessed: PD-L1 303-Fc-CTLA-4 2520 (SEQ ID NO: 2541), PD-L2 1417-Fc-CTLA-4 2520 (SEQ ID NO:2543) and PD-L1 303-CTLA-4 2520 (SEQ ID NO:2651). As a control, individual ARBM and IRBM molecules, in either a monomeric or Fc fusion protein format, also were assessed, including the individual PD-L1 IgV (SEQ ID NO:303; PD-L1 303), PD-L2 IgV (SEQ ID NO:1417, PD-L2 1417) or CTLA-4 ECD (SEQ ID NO: 36; CTLA-4 36), each containing a flag/his tag; the individual PD-L1 IgV (SEQ ID NO:303) fused to an Fc set forth in SEQ ID NO: 1715) (PD-L1 303-Fc); the individual PD-L2 IgV (SEQ ID NO:1417) fused to an Fc set forth in SEQ ID NO: 1715 (PD-L2 1417-Fc); or the individual CTLA-4 ECD (SEQ ID NO:2519) fused to an Fc set forth in SEQ ID NO: 1715 (CTLA-4 2519-Fc).

Figure 4A:
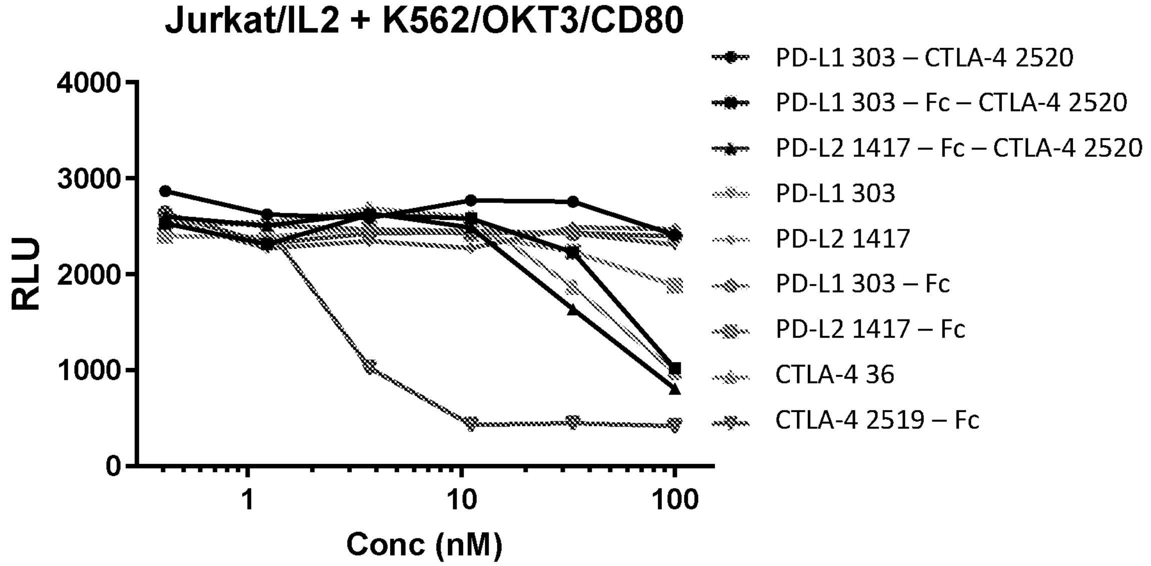
FIGS. 4A-4B show results from assessing exemplary PD-L1/PD-L2 and CTLA-4 multi-domain immunomodulatory proteins in the Jurkat/IL2 (Assay #1) and Jurkat/IL2/PD-1 (Assay #2) reporter assays.

Luciferase activity of Jurkat effector cells expressing IL-2-luciferase reporter co-cultured with K562 aAPCs in the presence of immunomodulatory molecules, as determined using Assay #1, is shown in FIG. 4A. In this assay, a decrease in luminescence values demonstrated binding of the immunomodulatory protein to its binding partner, CD80, blocked the interaction of CD28 and CD80. As shown, only CTLA-4 2519-Fc exhibited substantial blocking activity, while the assessed multi-domain immunomodulatory proteins did not exhibit substantial blocking inhibitory activity in this assay, except at the highest concentrations tested.

Figure 4B:
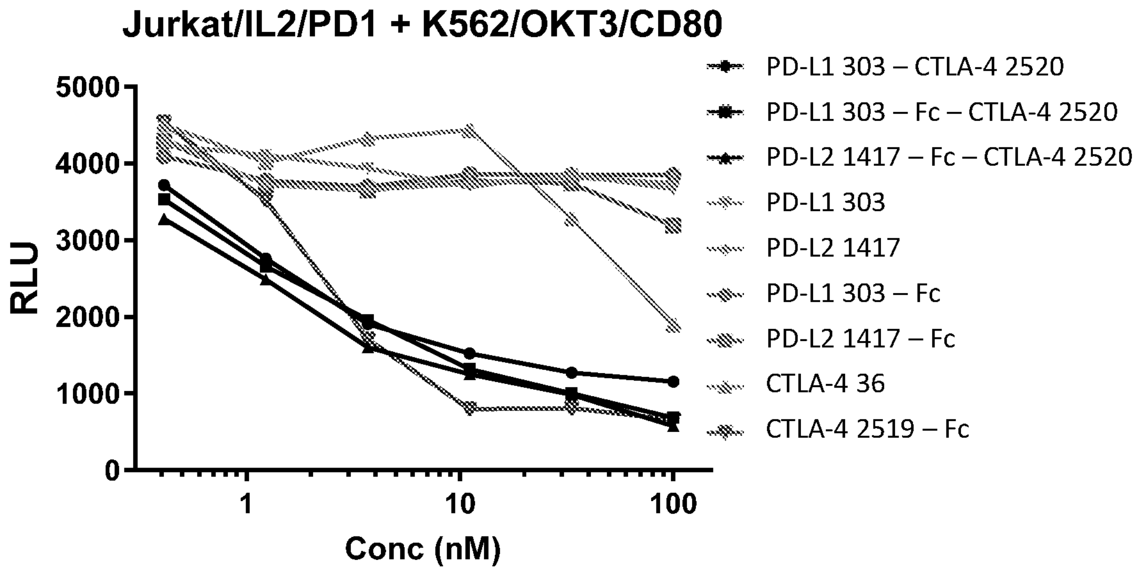

Luciferase activity of Jurkat effector cells expressing PD-1 and IL-2-luciferase reporter co-cultured with K562 aAPCs in the presence of immunomodulatory molecules, as determined using Assay #2, are shown in FIG. 4B. As shown, Jurkat cells incubated with assessed multi-domain immunomodulatory proteins showed a decrease in luminescence values. Combined with the results in assay #1 above, these results are consistent with an observation that inhibitory activity of the exemplary PD-L1/PD-L2 and CTLA-4 multi-domain immunomodulatory protein was due to binding to PD-1 and CD80.

Figure 12A:
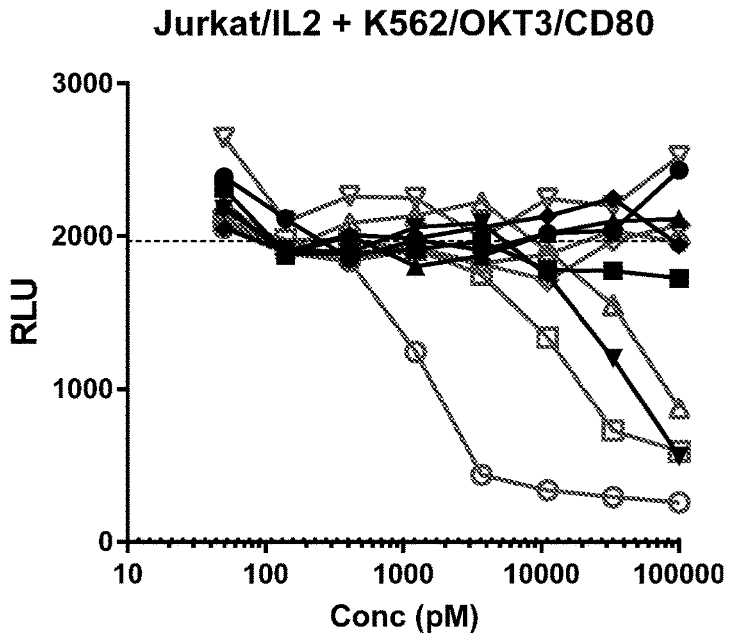
FIG. 12A-12B show results from assessing multi-domain immunomodulatory proteins containing a PD-L1 IgV or a PD-L2 IgV and CTLA-4 ECD, generated as multimeric homodimer immunomodulatory proteins in the Jurkat/IL2 (Assay #1) and Jurkat/IL2/PD-1 (Assay #2) reporter assays.
Figure 12A:
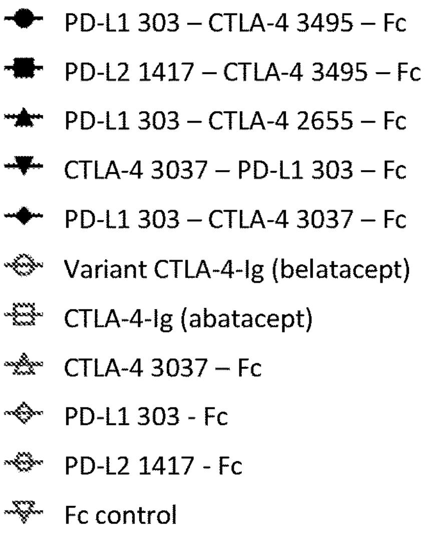
Figure 12B:
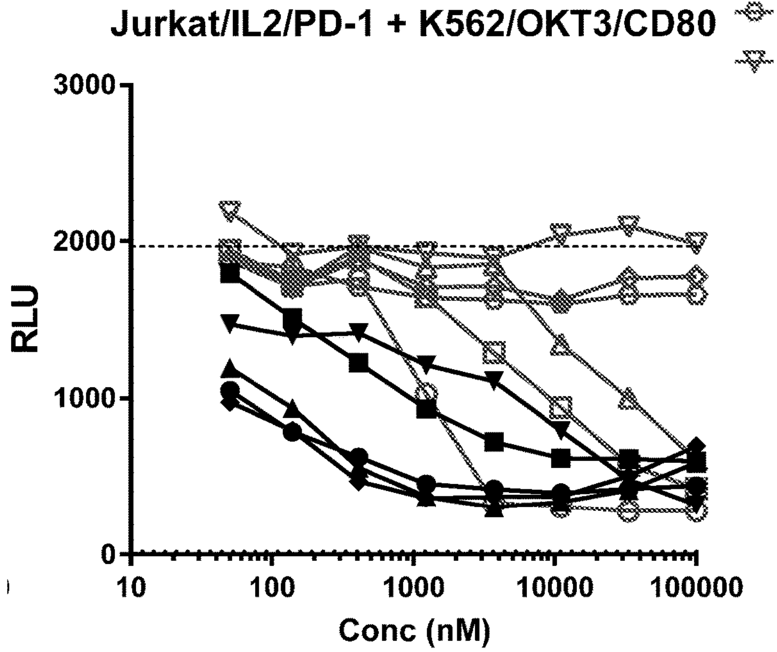

Additional tested molecules containing a PD-L1 IgV or a PD-L2 IgV and CTLA-4 ECD generated as multimeric homodimer immunomodulatory proteins tested in Assay #1 and Assay #2 are shown in FIGS. 12A and 12B, respectively. Exemplary multi-domain immunomodulatory proteins from Table E2 were assessed (at 100-0.05 nM) including those set forth in SEQ ID NOs: 3518, 3519, 3521, 3522, and 3523. In addition, control immunomodulatory proteins including (1) a variant PD-L1 IgV-Fc (SEQ ID NO:303), (2) a variant PD-L2 IgV-Fc (SEQ ID NO:1417); (3) a variant CTLA-4 ECD-Fc (SEQ ID NO: 3037), (4) a CTLA-4-Ig (abatacept), (5) a variant CTLA-4-Ig (belatacept), or (6) an Fc only control were tested. As shown, Jurkat cells incubated with assessed multi-domain immunomodulatory proteins showed a decrease in luminescence values and the results are consistent with the observation that inhibitory activity of the exemplary PD-L1/PD-L2 and CTLA-4 multi-domain immunomodulatory proteins was PD-1 dependent.

Figure 13A:
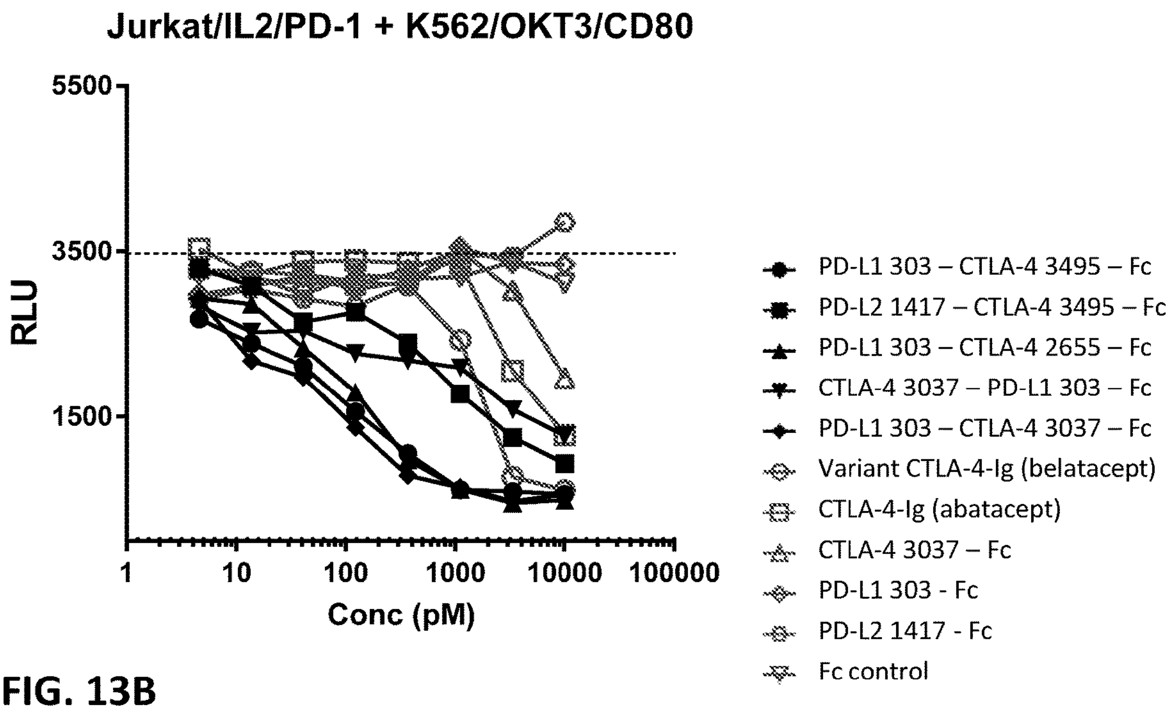
FIG. 13A-13B show results from assessing multi-domain immunomodulatory proteins containing a PD-L1 IgV or a PD-L2 IgV and CTLA-4 ECD, generated as multimeric homodimer immunomodulatory proteins in the Jurkat/IL2/PD-1 (Assay #2) reporter assay.
Figure 13B:
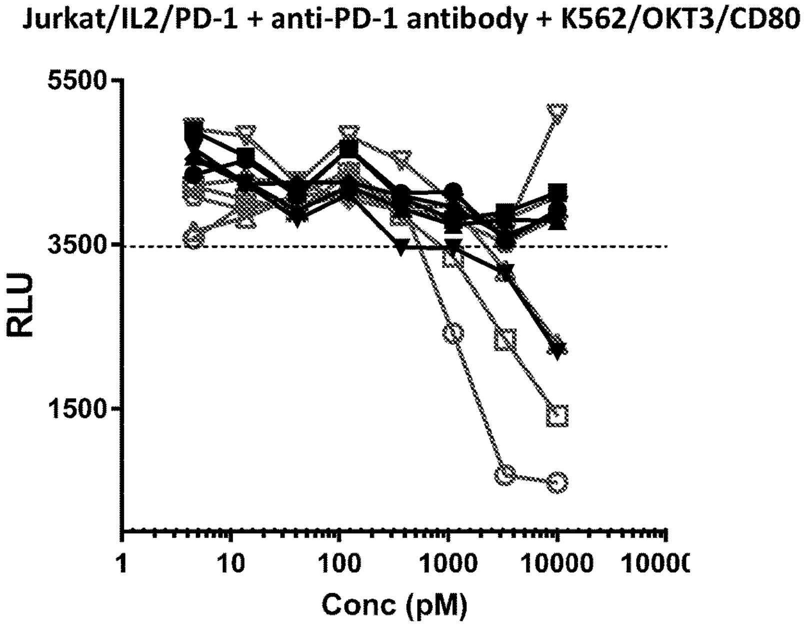
Figure 14A:
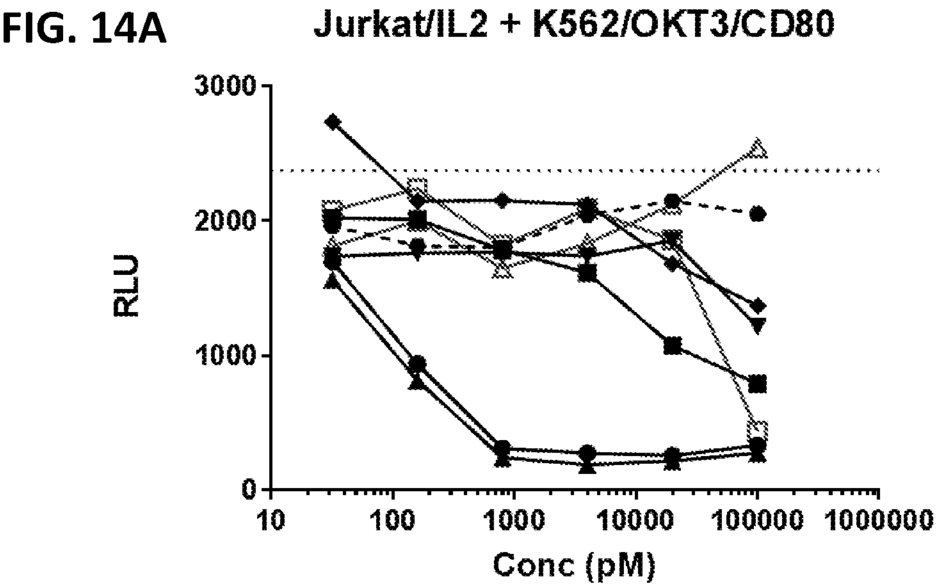
FIGS. 14A-14B, 15A-15B, and 16A-16B show results from assessing multi-domain immunomodulatory proteins containing a PD-L1 IgV or a PD-L2 IgV and ICOSL IgV, generated as multimeric homodimer immunomodulatory proteins in the Jurkat/IL2 (Assay #1) and Jurkat/IL2/PD-1 (Assay #2) reporter assays.
Figure 14B:
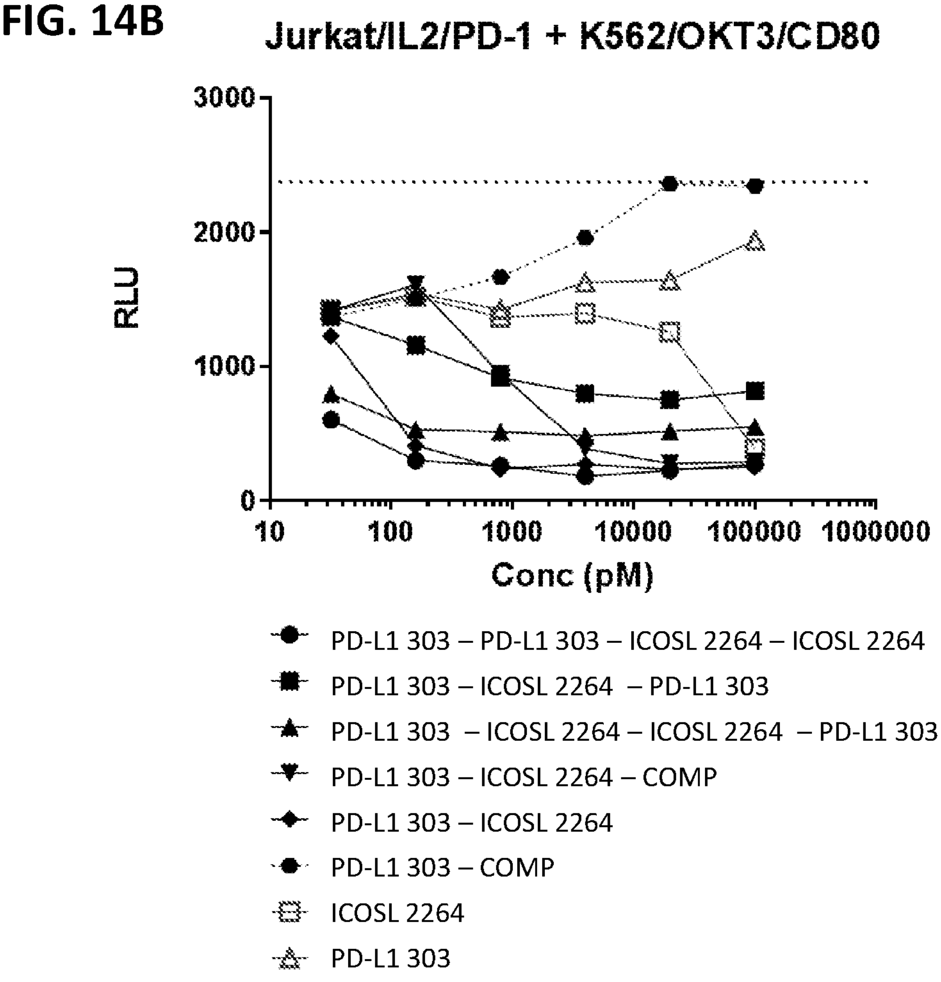
Figure 15A:
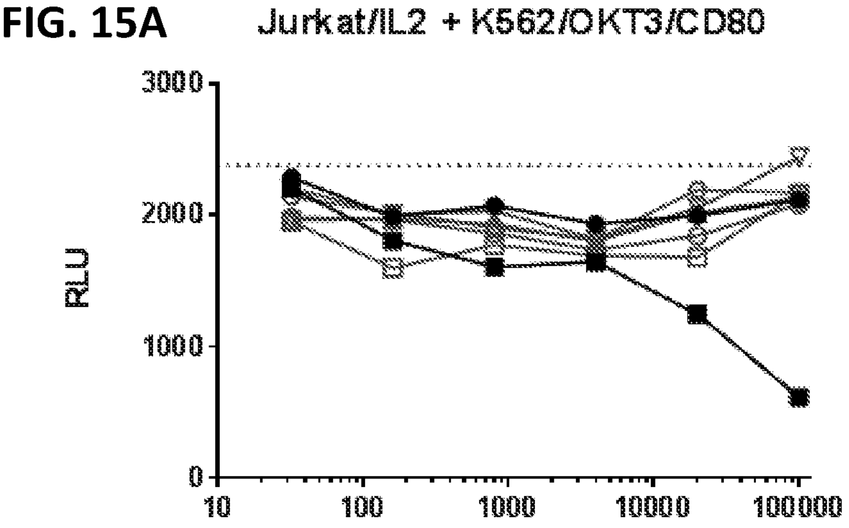
Figure 15B:
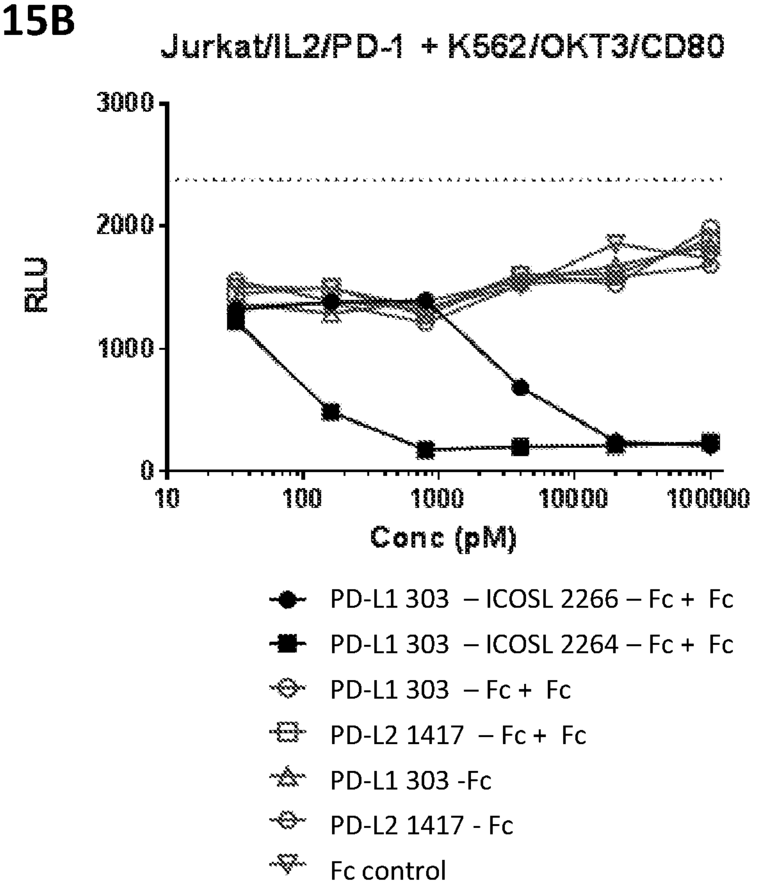
Figure 16A:
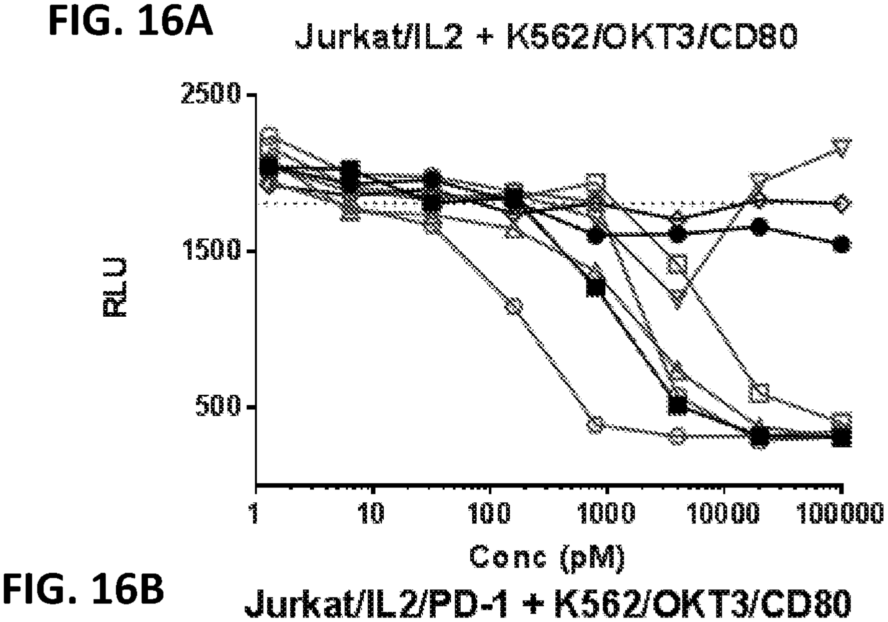
Figure 16B:
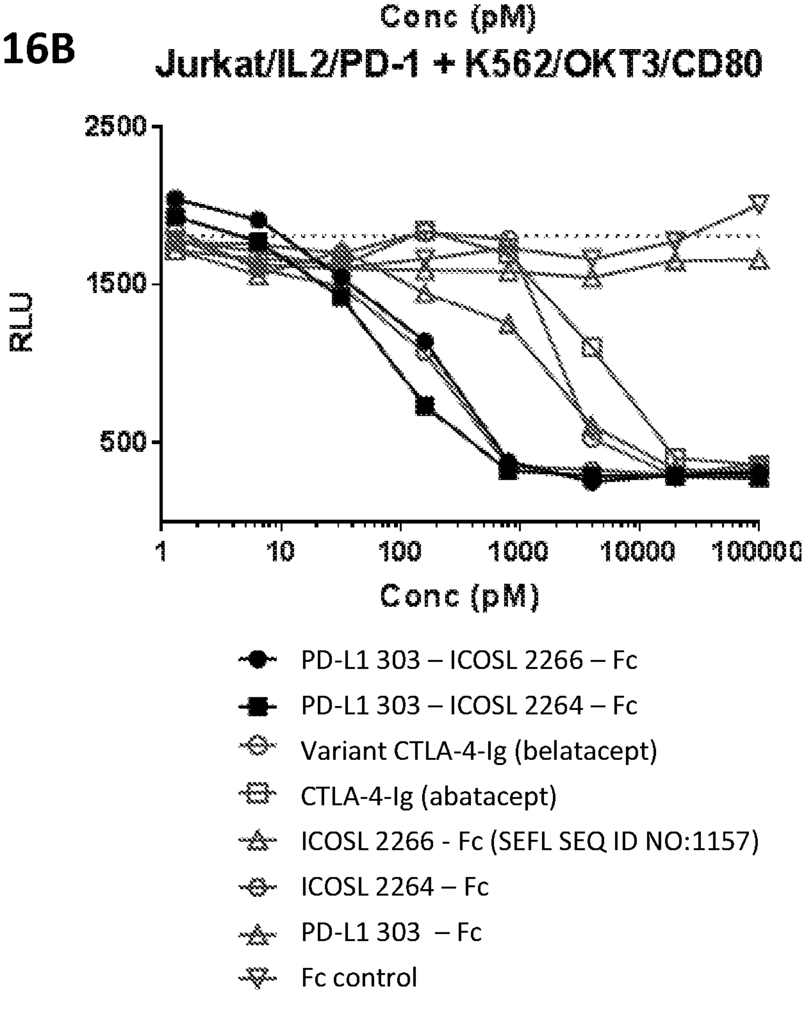

Similar to Assay #2, the exemplary multi-domain immunomodulatory proteins were further assessed by measuring luciferase activity of Jurkat effector cells expressing PD-1 and IL-2-luciferase reporter co-cultured with K562 aAPCs in the presence of immunomodulatory molecules except with the addition of either a human IgG or an anti-PD-1 antibody (nivolumab). As shown in FIGS. 13A and 13B, the inhibitory activity of the exemplary PD-L1/PD-L2 and CTLA-4 multi-domain immunomodulatory proteins was inhibited at the lower concentrations when PD-1 was blocked.

B. PD-L1/PD-L2-ICOSL

The assays described above were carried out on multi-domain immunomodulatory proteins, containing a PD-L1 IgV or a PD-L2 IgV and ICOSL IgV, generated as monomeric proteins. For PD-L1 IgV molecules, the following exemplary multi-domain immunomodulatory proteins were assessed: PD-L1 303-ICOSL 2247 (SEQ ID NO:2595), ICOSL 2247-PD-L1 303 (SEQ ID NO:2597), PD-L1 303-ICOSL 2266 (SEQ ID NO:2599), ICOSL 2266-PD-L1 303 (SEQ ID NO:2601), PD-L1 303-ICOSL 2264 (SEQ ID NO:2603), ICOSL 2264-PD-L1 303 (SEQ ID NO:2605), PD-L1 303-ICOSL 2244 (SEQ ID NO: 2607), and ICOSL 2244-PD-L1-303 (SEQ ID NO:2609). For PD-L2 IgV molecules, the following exemplary multi-domain immunomodulatory proteins were assessed: PD-L2 1417-ICOSL 2247 (SEQ ID NO:2579), ICOSL 2247-PD-L2 1417 (SEQ ID NO:2581), PD-L2 1417-ICOSL 2266 (SEQ ID NO:2583), ICOSL 2266-PD-L2 1417 (SEQ ID NO:2585), PD-L2 1417-ICOSL 2264 (SEQ ID NO:2587), ICOSL 2264-PD-L2 1417 (SEQ ID NO:2589), PD-L2 1417-ICOSL 2244 (SEQ ID NO: 2591), and ICOSL 2244-PD-L2 1417 (SEQ ID NO:2593). As a control, individual ARBM and IRBM molecules, in a monomeric protein format, also were assessed, including PD-L1 IgV (SEQ ID NO:303; PD-L1 303), PD-L2 IgV (SEQ ID NO:1417, PD-L2 1417) or ICOSL IgV (SEQ ID NO:2264; ICOSL 2264). The ICOSL 2264 alone control exhibited comparable activity to the CTLA-4 ECD Fc containing A31Y/L106E (SEQ ID NO: 2519) described in FIGS. 4A and 4B. An Fc only control also was assessed.

Figure 5A:
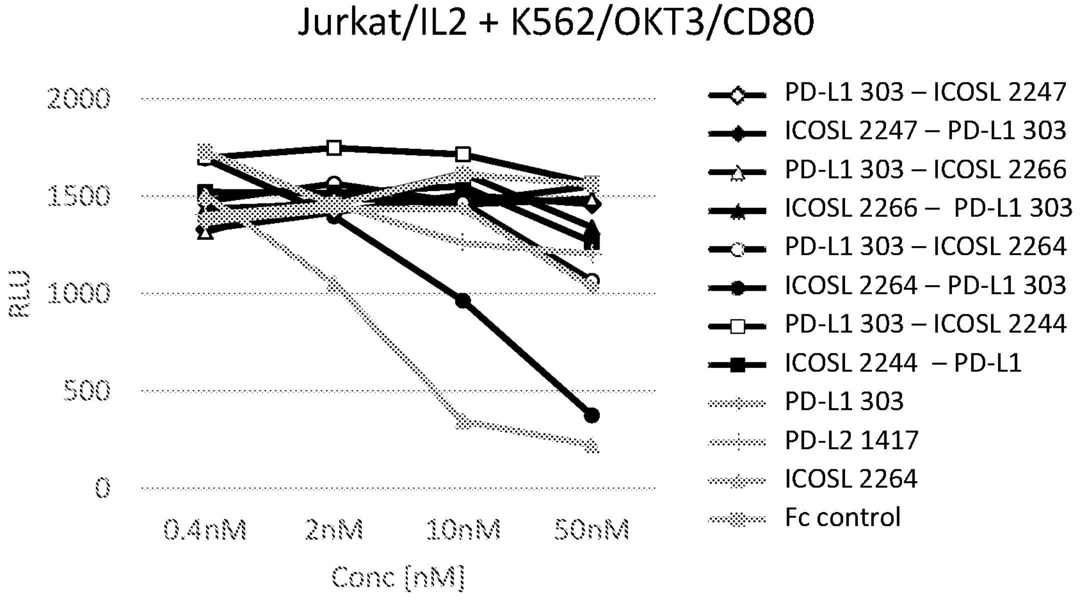
FIGS. 5A-5B and 6A-6B show results from assessing multi-domain immunomodulatory proteins containing a PD-L1 IgV or a PD-L2 IgV and ICOSL IgV, generated as monomeric proteins in the Jurkat/IL2 (Assay #1) and Jurkat/IL2/PD-1 (Assay #2) reporter assays.
Figure 5B:
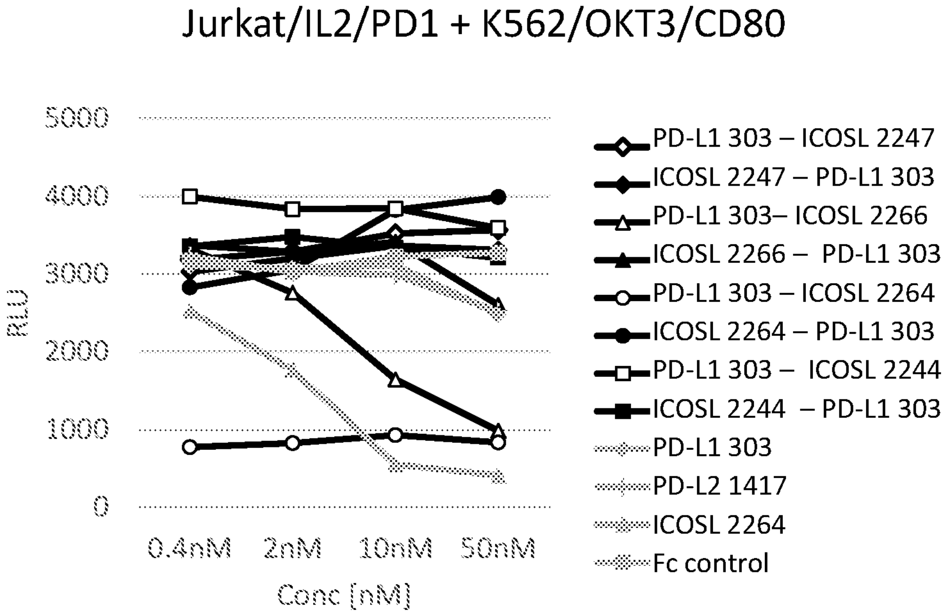

For PD-L1 IgV-containing immunomodulatory proteins, luciferase activity of Jurkat effector cells co-cultured with K562 aAPCs in the presence of immunomodulatory molecules as determined using Assay #1 or Assay #2 are shown in FIGS. 5A and 5B, respectively. As shown in FIG. 5A, the multi-domain immunomodulatory protein ICOSL 2264-PD-L1 303 (SEQ ID NO:2605) exhibited activity to block the interaction of CD28 and CD80, although the blocking activity was less than the individual ICOSL IgV (SEQ ID NO: 2264) immunomodulatory protein. As shown in FIG. 5B, Jurkat cells incubated with exemplary multi-domain immunomodulatory proteins PD-L1 303-ICOSL 2266 (SEQ ID NO:2599) and PD-L1 303-ICOSL 2264 (SEQ ID NO:2603) showed a decrease in luminescence values.

Figure 6A:
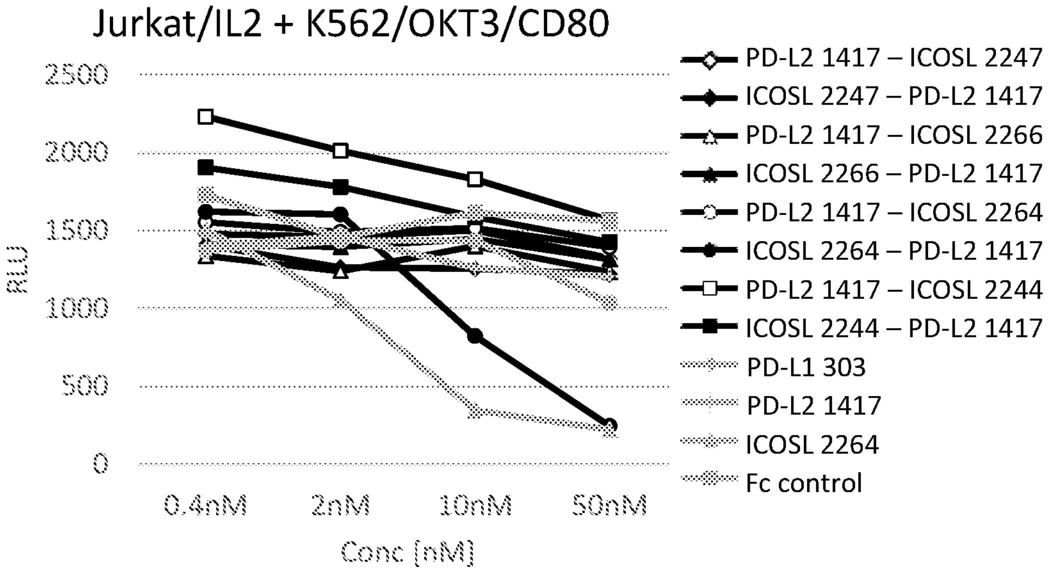
Figure 6B:
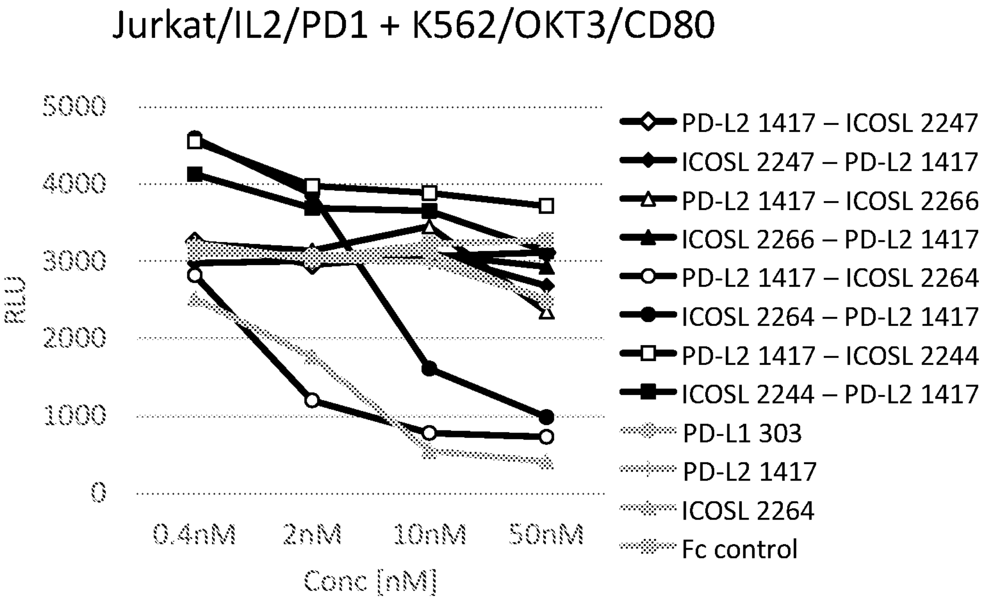

For PD-L2 IgV-containing immunomodulatory proteins, luciferase activity of Jurkat effector cells co-cultured with K562 aAPCs in the presence of immunomodulatory molecules as determined using Assay #1 or Assay #2 are shown in FIGS. 6A and 6B, respectively. As shown in FIG. 6A, the multi-domain immunomodulatory protein ICOSL 2264-PD-L2 1417 (SEQ ID NO:2589) exhibited activity to block the interaction of CD28 and CD80, although the blocking activity was less than the individual ICOSL IgV (SEQ ID NO: 2264) immunomodulatory protein. As shown in FIG. 6B, Jurkat cells incubated with exemplary multi-domain immunomodulatory proteins PD-L2 1417-ICOSL 2264 (SEQ ID NO:2587) showed a decrease in luminescence values.

Combined with the results in assay #1 above, these results are consistent with an observation that inhibitory activities of the exemplary PD-L1 303-ICOSL 2266 (SEQ ID NO:2599), PD-L1 303-ICOSL 2264 (SEQ ID NO:2603) and PD-L2 1417-ICOSL 2264 (SEQ ID NO:2587) multi-domain immunomodulatory protein were due to binding to PD-1 and CD28. The results also indicate that affinity maturation of individual IgSF domains also can improve the observed activity, since, in this experiment, inhibitory activity was not observed in either assay #1 or assay #2 with the exemplary immunomodulatory protein containing a wild-type ICOSL IgV domain (e.g. containing ICOSL 2244) or containing a ICOSL variant with lower improved affinity for cognate binding partners (e.g. containing ICOSL 2266).

Additional tested molecules containing a PD-L1 IgV or a PD-L2 IgV and ICOSL IgV generated as multimeric homodimer immunomodulatory proteins tested in Assay #1 and Assay #2 are shown in FIGS. 14A, 15A, 16A and 14B, 15B, 16B respectively. Exemplary multi-domain immunomodulatory proteins from Tables E3B, E4 and E5 were assessed including those as set forth in SEQ ID NO: 3500, 3501, 3502, 3507, 3496, 3513+3514, and 3515+3514. Individual ARBM or IRBM containing molecules were also assessed, including those with PD-L1 (SEQ ID NO: 303, 3506, 3525, 3533+3534), with ICOSL (SEQ ID NO: 3527, 3528), and with PD-L2 (SEQ ID NO:1417, 3533+3512). An Fc only control also was assessed. Jurkat cells incubated with assessed multi-domain immunomodulatory proteins showed a decrease in luminescence values, demonstrating the inhibitory activity of the exemplary PD-L1/PD-L2 and ICOSL multi-domain immunomodulatory proteins.

Example 4

Assessment of Immunomodulatory Proteins Containing Activating and Inhibitory Components with Blocking Antibody To assess dependence of the inhibitory activity of exemplary multi-domain immunomodulatory proteins on binding of PD-1, the Jurkat/IL2/PD-1 reporter assay described in Example 3 (Assay #2) was carried out in the presence of a blocking antibody. Specifically, in this example, the following exemplary multi-domain immunomodulatory proteins were assessed: PD-L1 303-Fc-CTLA-4 2520 (SEQ ID NO: 2541), PD-L2 1417-Fc-CTLA-4 2520 (SEQ ID NO:2543) and PD-L1 303-CTLA-4 2520 (SEQ ID NO:2651). As a control, monomeric variant CTLA-4 ECD (CTLA-4-2520) containing a flag/his tag, or a variant CTLA-4-Fc fusion (containing CTLA-4 ECD set forth in SEQ ID NO:2519 fused to an Fc set forth in SEQ ID NO: 1715; CTLA-4 2519-Fc) were assessed. Activity in the presence of an Fc only control also was assessed. Assay #2 was performed essentially as described above. All test proteins were added at 11 nM and where indicated, anti-PD-1 antibody was added at 10 nM. For each condition, an average relative luminescence value was determined for each test immunomodulatory protein or control protein.

Figure 7:
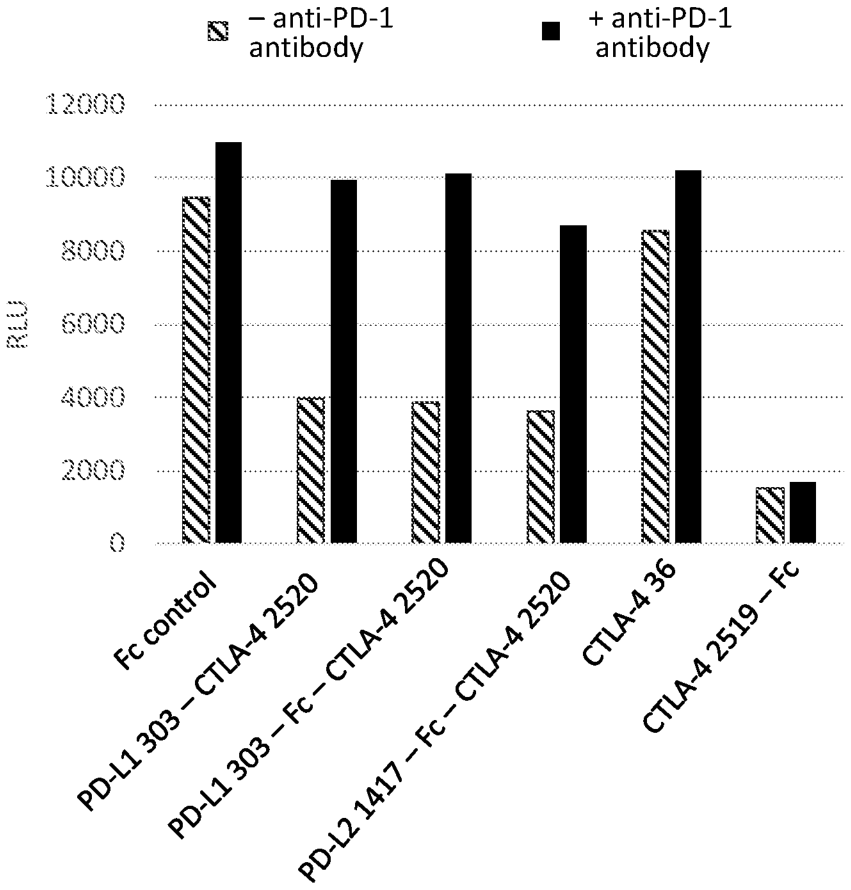
FIG. 7 depicts results from the Jurkat/IL2/PD-1 reporter assay (Assay #2) carried out in the presence of a PD-1 blocking antibody demonstrating PD-1 specificity for exemplary multi-domain immunomodulatory molecules containing PD-L1 IgV/PD-L2 IgV and CTLA-4-ECD.

As shown in FIG. 7, luciferase activity of Jurkat effector cells expressing PD-1 and IL-2-luciferase reporter was decreased when co-cultured with anti-CD3/PD-L1 aAPC in the presence of the assessed exemplary multi-domain immunomodulatory molecules containing PD-L1 IgV/PD-L2 IgV and CTLA-4-ECD or with the exemplary variant CTLA4-Fc. In contrast, there was no decrease in luciferase activity when co-cultured with the individual variant CTLA-4 in monomeric form or the Fc only control proteins. Addition of the anti-PD-1 antibody blocked the decrease in luciferase in conditions containing the exemplary multi-domain immunomodulatory molecules containing the variant PD-L1 IgV/PD-L2 IgV and variant CTLA-4, but not with the individual variant CTLA-4-Fc molecule. The blocking by the anti-PD-1 antibody is consistent with the inhibitory activity of the multi-domain immunomodulatory proteins being at least partly dependent on binding PD-1.

Example 5

Assessment of Bioactivity of Immunomodulatory Proteins Containing PD-L1 IgV/PD-L2 IgV-CD80/CD86 IgV The Jurkat/IL2/PD-1 reporter assay (Assay #2) described in Example 3 was carried out in the presence of exemplary PD-L1 IgV/PD-L2 IgV-CD80/CD86 IgV. The assay was carried out substantially as described in Example 3 by incubating Jurkat/IL2/PD-1 reporter cells with exemplary immunomodulatory proteins (at concentrations ranging from 0.4 nM to 50 nM) for approximately 15 minutes prior to adding K562/OKT3/CD80 aAPC. Specifically, the assessed multi-domain immunomodulatory proteins included monomeric proteins containing a variant PD-L1 IgV (e.g. PD-L1 303) or a variant PD-L2 IgV (e.g. PD-L2 1417) linked in various configurations to either wildtype CD80 IgV (SEQ ID NO: 2615), a variant CD80 IgV (SEQ ID NO: 2616) or wild-type CD86 (SEQ ID NO: 2610), as shown in FIGS. 8A-8C.

As a control, individual IRBM or ARBM molecules also were assessed as follows: PD-L1 IgV (SEQ ID NO:303; PD-L1 303), PD-L2 IgV (SEQ ID NO:1417, PD-L2 1417) or ICOSL IgV (SEQ ID NO: 2264; ICOSL-2264), each containing a flag/his tag. An Fc only control also was assessed.

Figure 8A:
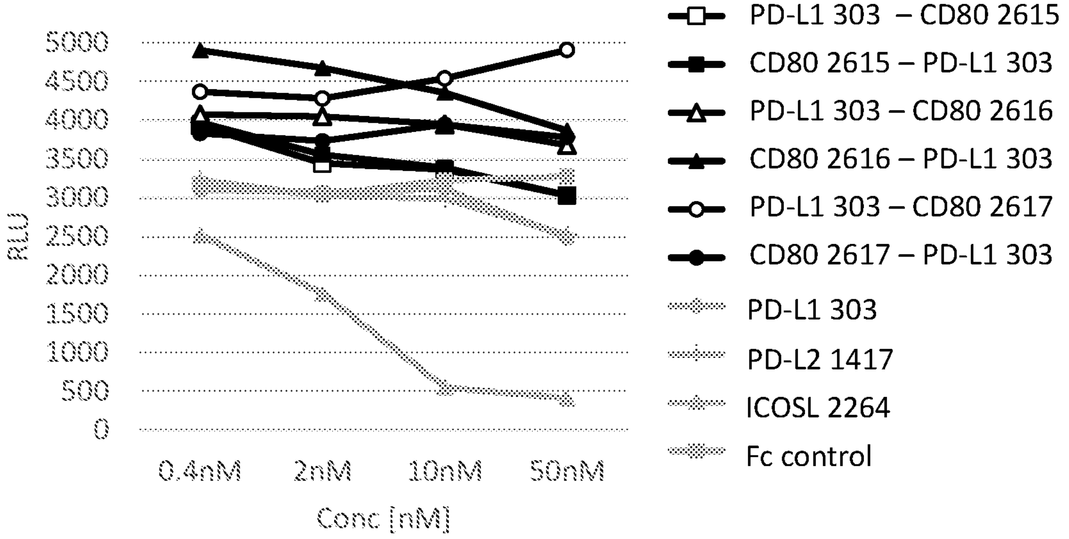
FIGS. 8A-8C show results from assessing multi-domain immunomodulatory proteins containing PD-L1 IgV/PD-L2 IgV and CD80/CD86 IgV generated as monomeric proteins in the Jurkat/IL2/PD-1 (Assay #2) reporter assay.
Figure 8B:
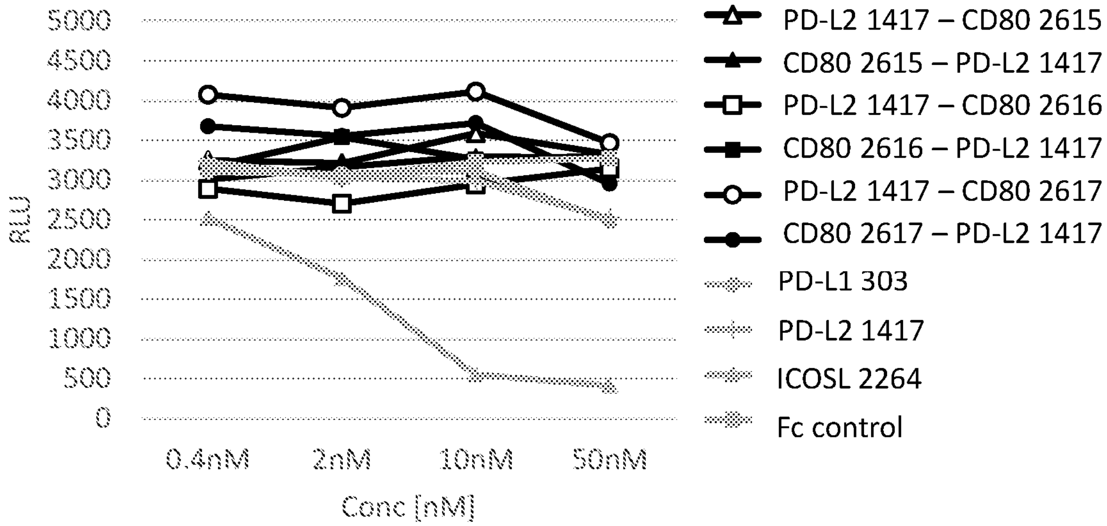
Figure 8C:
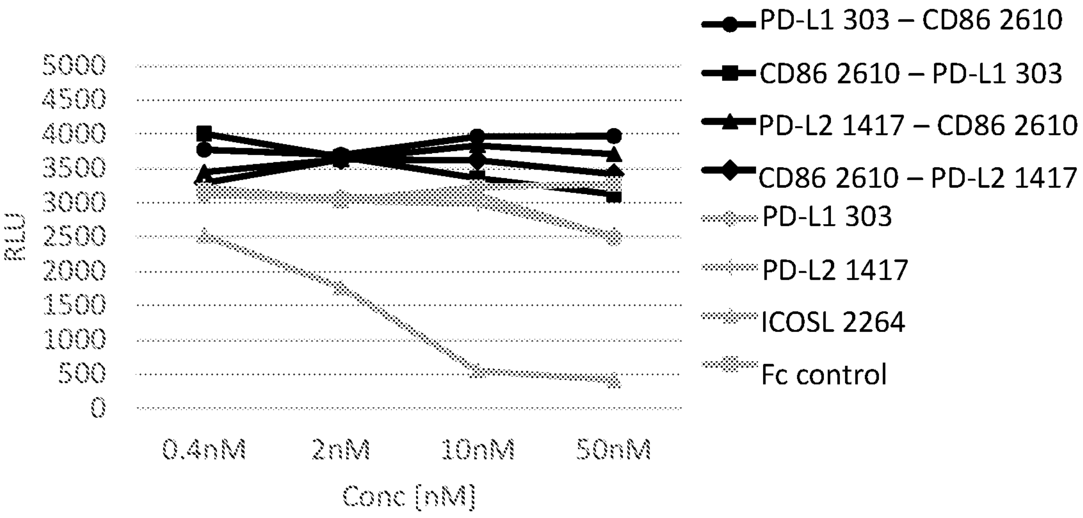

Results with multi-domain immunomodulatory proteins containing PD-L1 IgV-CD80 IgV are shown in FIG. 8A, multi-domain immunomodulatory proteins containing PD-L2 IgV-CD80 IgV are shown in (FIG. 8B), and multi-domain immunomodulatory proteins containing PD-L1 IgV/PD-L2 Igv-CD86 IgV are shown in (FIG. 8C). As shown in FIG. 8A-8C, the luciferase activity of the Jurkat effector cells in the presence of the individual variant ICOSL IgV protein was decreased while the multi-domain immunomodulatory proteins did not exhibit suppression of CD28 costimulation in this assay.

Example 6

Assessment of PD-1/CD28 Proximalization Using Dimerization Assay

This Example describes a PD-1/CD28 proximalization assay to assess effects of exemplary multi-domain immunomodulatory protein upon binding to its targets. The assay was a proximity dimerization assay using a beta-Galactosidase (beta-Gal) Enzyme Fragment Complementation assay system. The assay utilizes a first surface expressed protein fused with an enzyme donor tag (ProLink™ (PK)) and a second surface expressed protein fused with an enzyme acceptor protein (EA). When in close proximity, complementation of the two enzyme fragments occurs, forming a functional beta-Gal enzyme that hydrolyzes a substrate to generate a chemiluminescent signal.

A. Generation of PD-1-CD28 EA/PK Fusion Cell Lines

To assess proximalization of the inhibitory receptor (PD-1) and activating receptor (CD28), mammalian expression vectors were designed to express the extracellular and transmembrane domains of full-length CD28 (CD28 FL) or truncated CD28 (residues 1-188, SEQ ID NO:2944; tCD28)) fused to the PK- and EA-tag at the C-terminus. The CD28 constructs were then transfected via retroviral infection into a human U2OS parental cell line (DiscoverX, USA; cat. #93-1130C3) that expressed human PD-1 (amino acids 1-199) fused to either EA (PD1-EA; U2OS PD1(1-199)-EA cell line) or PK (PD1-PK; U2OS PD1(1-199)-PK cell line). Four cells lines were generated as follows: U2OS CD28 (FL)-PK/PD-1(1-199)-EA, U2OS PD-1(1-199)-PK/CD28 (FL)-EA, U2OS CD28(1-188)-PK/PD-1(1-199)-EA and U2OS PD-1(1-199) PK/CD28(1-188)-EA. The resulting cells were selected with the appropriate selective agents to generate stable cell lines.

The PD-1-CD28 cells lines were assessed for expression of the PK-fusion protein and EA-fusion protein using in vitro complementation assays, where the cells were evaluated for enzyme activity in the absence and presence of exogenous complementing fragment. Stable U2OS cell lines co-expressing either PD-1(1-199)-PK or -EA fusion proteins with full-length or truncated CD28(1-188)-EA or —PK were lysed in the presence of beta-Gal enzyme substrate only or in the presence of beta-Gal enzyme substrate with complementary EA or PK enzyme fragment added. After 1 hour of incubation, luciferase activity was measured. The luciferase values found in the four PD1-CD28 cell lines were elevated after adding complementary EA or PK enzyme fragments as compared to the basal enzyme activity observed in cell lines in the absence of added EA or PK enzyme fragments, indicating complementation of the fusion proteins. The addition of complementary enzyme fragments for the PD1 fusion proteins in each lysed cell line resulted in greater increases in luciferase activity than conditions containing complementary enzyme fragments for the CD28 fusion protein, consistent with a higher expression of PD-1 in the cell lines. Immunostaining for PD-1 and CD28 in the cell lines by flow cytometry confirmed higher expression of PD-1 than CD28 in the cell lines.

B. Effect of Multi-Domain Immunomodulatory Proteins in Proximalization Assay

To assess the effect of multi-domain immunomodulatory proteins in the assay, the U2OS PD1-CD28 cell lines (U2OS CD28(FL)-PK/PD-1(1-199)-EA, U2OS CD28(1-188)-PK/PD-1(1-199)-EA or U2OS PD-1(1-199) PK/CD28(1-188)-EA) were plated at 5000 cells/well in quadruplicate in wells of a 384 well plates and cells were allowed to adhere to the plates for about 4 hours at 37° C./5% CO2. Multi-domain immunomodulatory proteins were added to the cells in a series of 1:3 dilutions. Specifically, exemplary monomeric multi-domain immunomodulatory proteins were assessed as follows: PD-L1 303-ICOSL 2264 (SEQ ID NO:2603) and PD-L2 1417-ICOSL 2264 (SEQ ID NO:2587). As a control, the individual variant PD-L2 IgV set forth in SEQ ID NO:1417 also was assessed. The plates were incubated overnight (16 hours) at 37° C./5% $CO_2$. The substrate for beta-Gal was added to the cells, incubated for 1 hour in the dark at room temperature, and luciferase levels were measured.

Figure 9A:
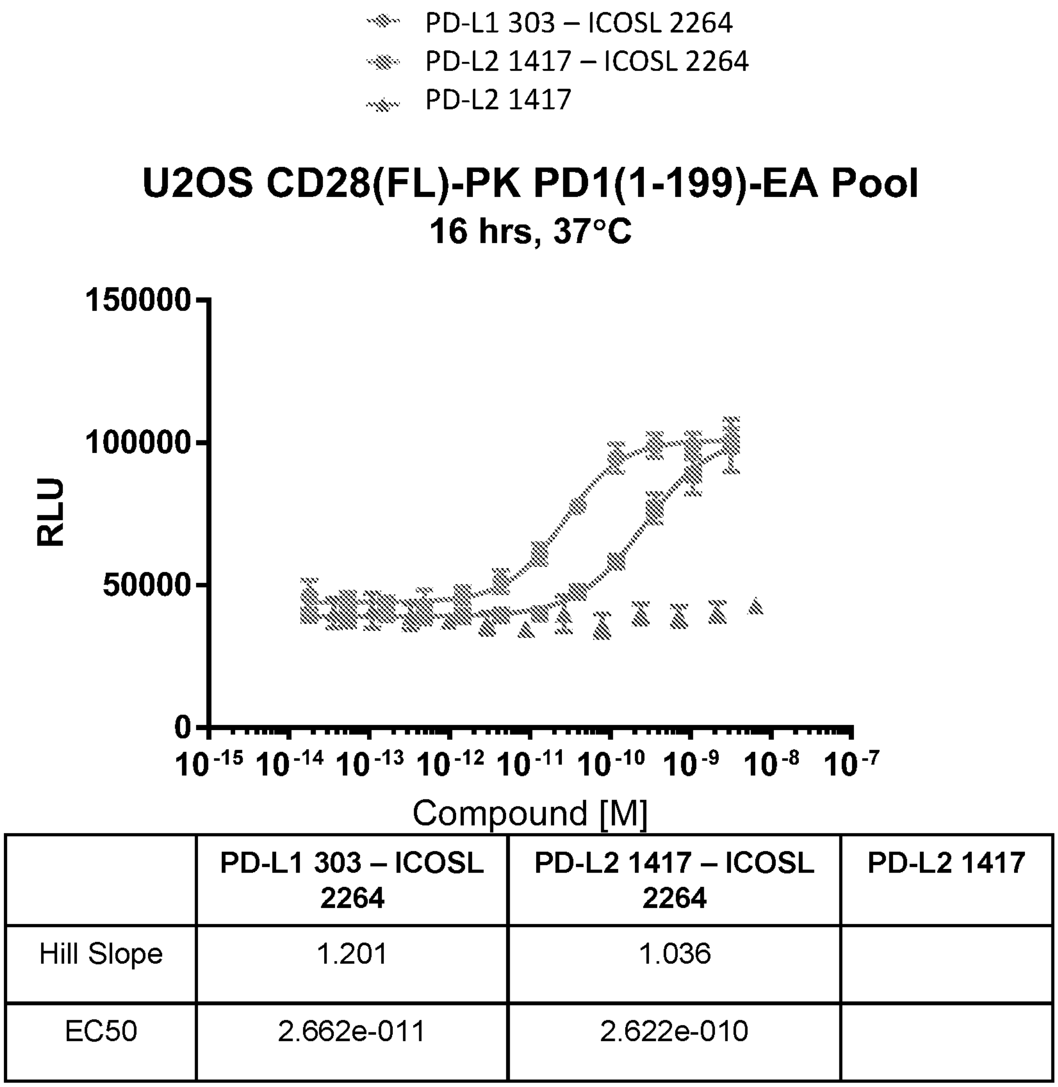
FIGS. 9A-9C show results from a PD-1/CD28 proximalization assay using a beta-Galactosidase (beta-Gal) Enzyme Fragment Complementation system to assess effects of exemplary multi-domain immunomodulatory protein containing PD-L1/PD-L2 and ICOSL IgV upon binding to its targets.
Figure 9B:
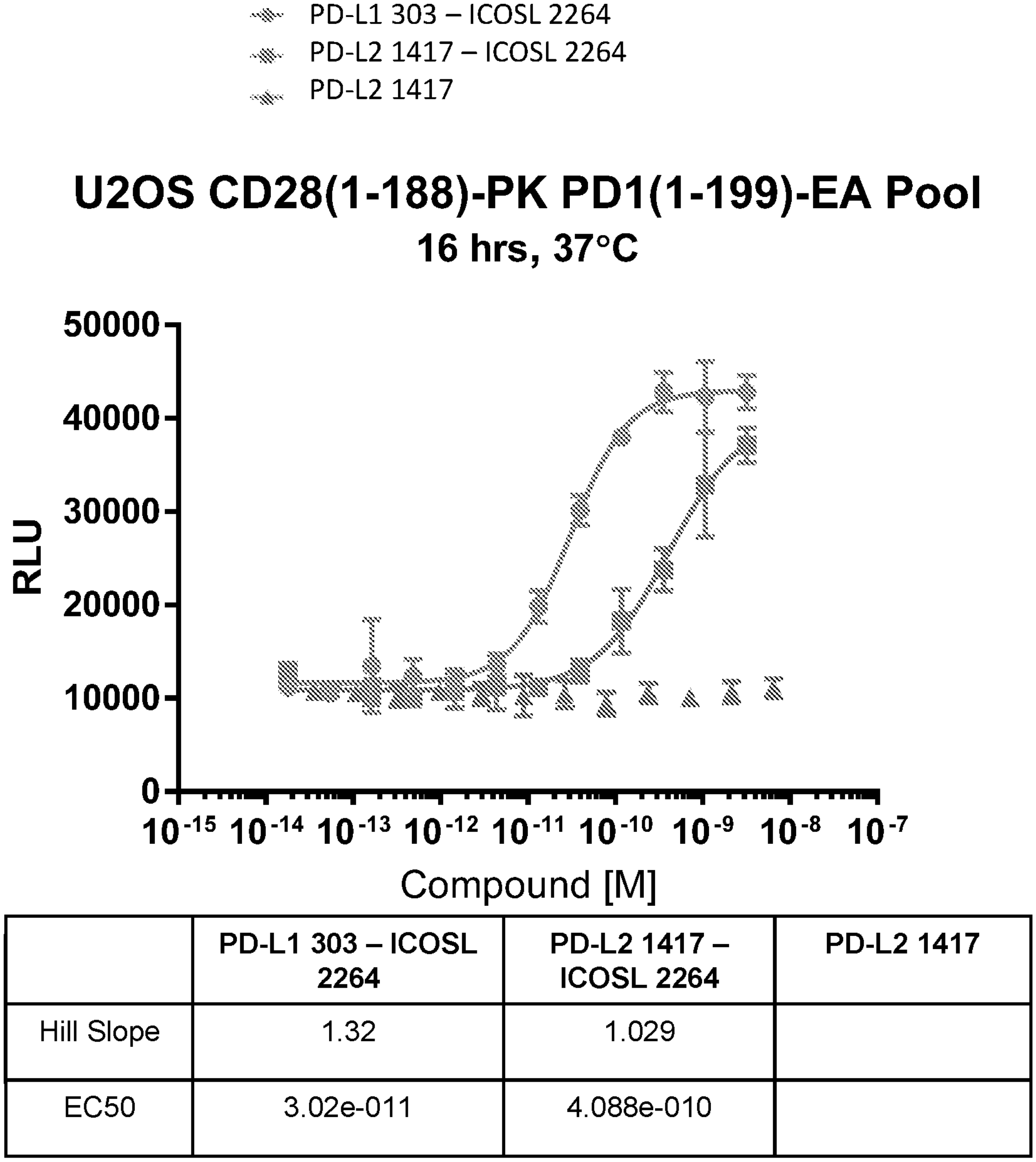
Figure 9C:
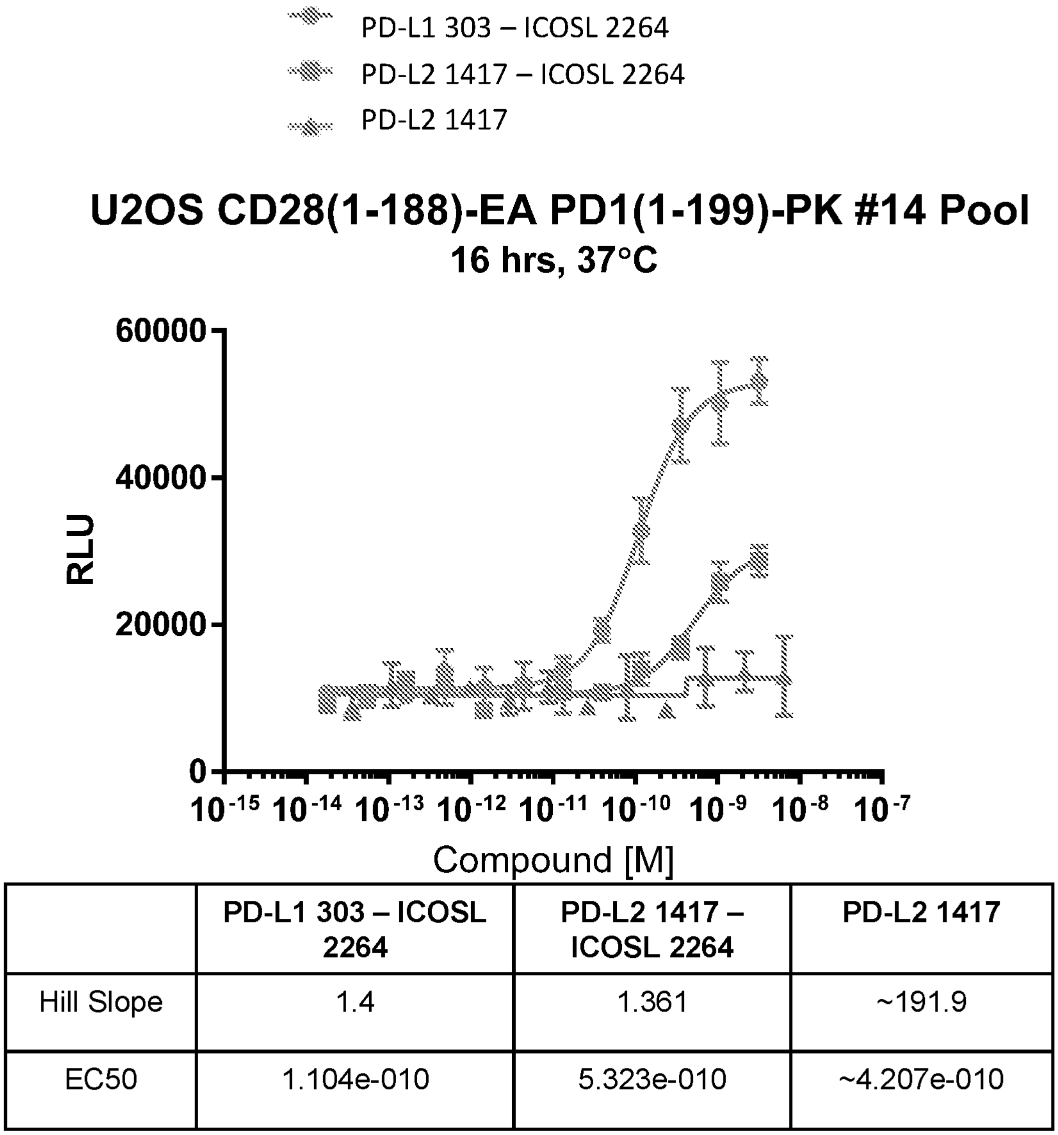

As shown in FIG. 9A-9C, the luciferase signal was increased in U2OS PD1-CD28 cells incubated with the exemplary multi-domain immunomodulatory proteins containing variant PD-L1/PD-L2 and ICOSL IgSF domains. In contrast, no substantial signal was detected in the presence of the individual variant PD-L2 IgV control protein. These data are consistent with an observation that the exemplary multi-domain immunomodulatory proteins were able to bind both the PD-1 inhibitory receptor and CD28 activating receptor, thereby resulting in their close proximity to each other. This result supports a finding that inhibitory activity of the multi-domain immunomodulatory molecules in cells that express both the PD-1 inhibitory receptor and CD28 activating receptor may be due to ability of the immunomodulatory proteins to induce PD-1/CD28 proximalization.

Example 7

Assessment of Protein Tyrosine Phosphatase Recruitment to PD-1

This Example describes a Jurkat PD-1 SHP2 Signaling Assay to assess the effect of the multi-domain immunomodulatory proteins to recruit the cytoplasmic protein tyrosine phosphatase, SHP-1 or SHP-2, to PD-1. In an exemplary assay, a Jurkat cell line containing a ProLink™ (PK) tagged PD-1 receptor and an Enzyme Acceptor (EA) tagged SHP-2 domain were used (e.g. DiscoverX, USA; cat. #93-1106C19). In the assay, SHP-2 recruitment to PD-1 results in the EA and PK being in close proximity to allow complementation of the two enzyme fragments forming a functional beta-Gal enzyme that hydrolyzes a substrate to generate a chemiluminescent signal.

A. PD-L1/PD-L2-ICOSL

Figure 10A:
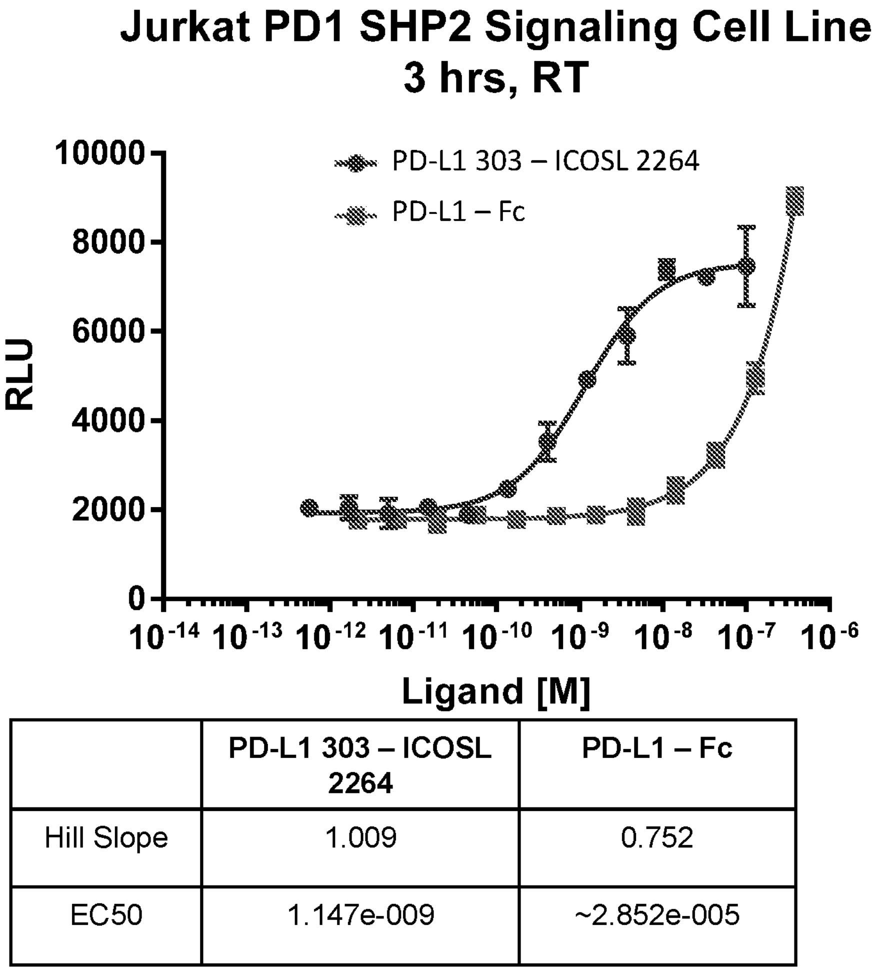
FIGS. 10A-10B show results from a Jurkat PD-1 SHP2 Signaling Assay to assess the effect of the multi-domain immunomodulatory protein (PD-L1 303-ICOSL 2264) to recruit the cytoplasmic protein tryosine phosphatase, SHP-1 or SHP-2, to PD-1.
Figure 10B:
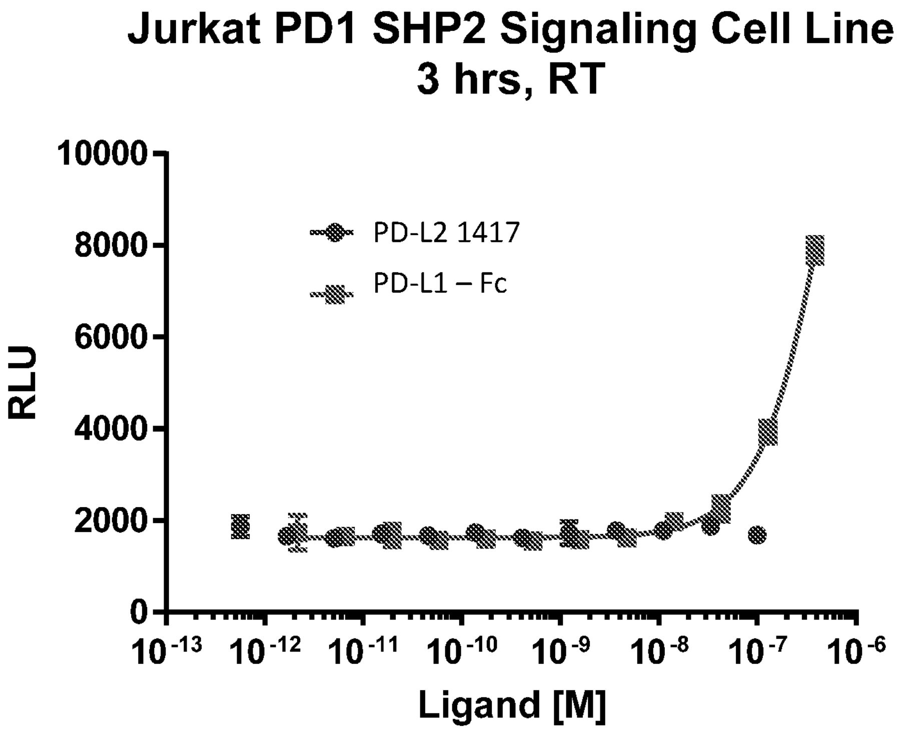

Jurkat PD-1-PK/SHP2-EA cells were plated in quadruplicate in wells of a 384 well plate at a density of about 5000 cells/well. The exemplary multi-domain immunomodulatory protein PD-L1 303-ICOSL 2264 (SEQ ID NO:2603) was added to the cells in a series of 1:3 dilutions. As a control, wild-type PD-L1 as an Fc fusion (PD-L1-Fc; R&D Systems, Cat. No. 156-B7) or the individual variant PD-L2 IgV set forth in SEQ ID NO:1417 as a monomeric protein were assessed. Cells were incubated for 3 hours at room temperature. The substrate for beta-Gal was added to the wells, incubated for 1 hour at room temperature in the dark, and the luciferase was measured. As shown in FIG. 10A, the exemplary PD-L1-ICOSL multi-domain immunomodulatory protein was substantially more potent than the PD-L1-Fc. As shown in FIG. 10B, no luciferase signal was detected in the presence of a monomeric variant PD-L2 IgV. These results are consistent with an observation that the multi-domain immunomodulatory protein exhibits potent activity to induce SHP-2 recruitment to PD-1. Further, this result is independent of antigen presenting cells (APC), since the result was achieved without co-culture with APCs.

Figure 17A:
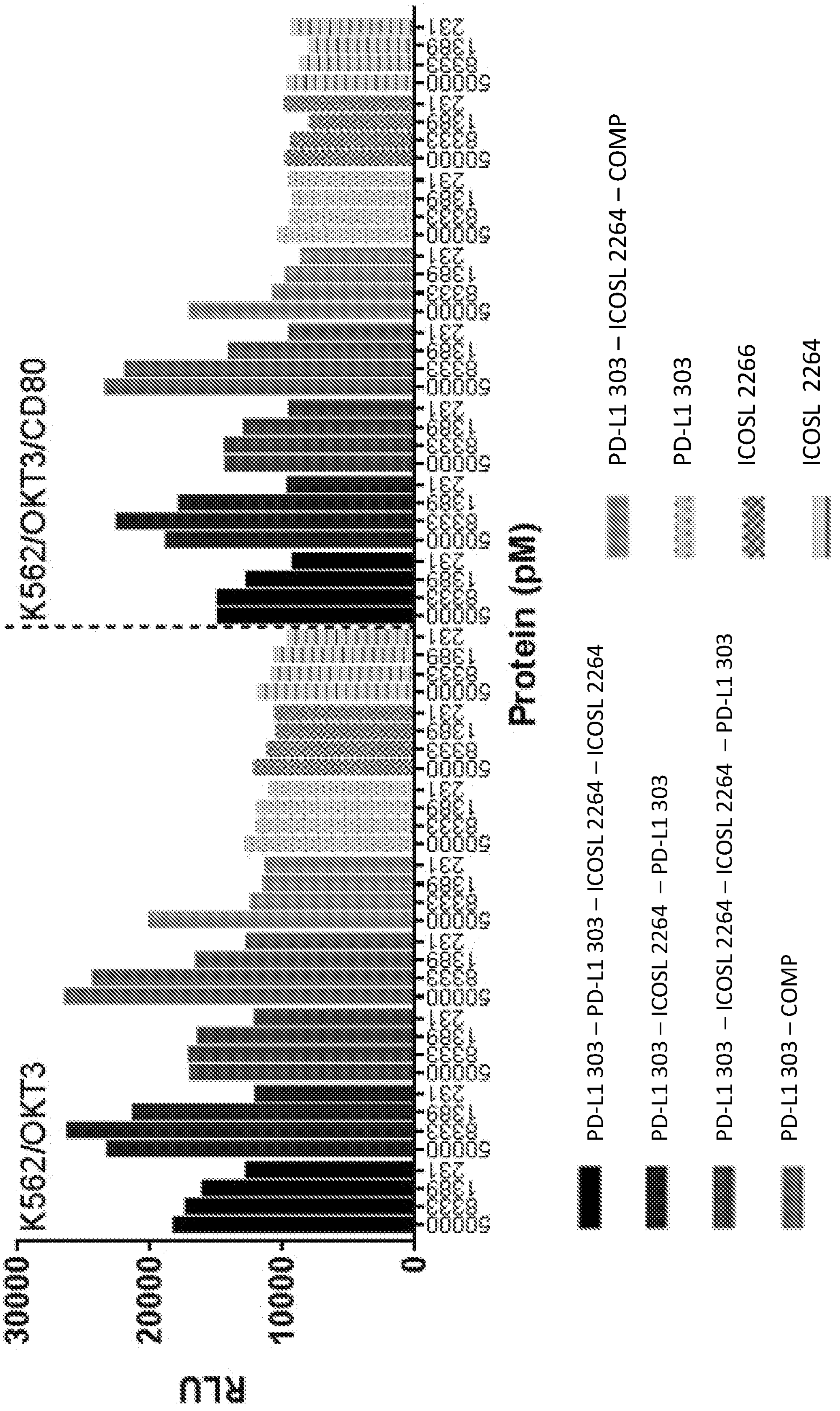
FIG. 17A-17C show results from a Jurkat PD-1 SHP2 Signaling Assay to assess the effect of monomeric or multimeric heterodimer PD-L1-ICOSL multi-domain immunomodulatory proteins to recruit the cytoplasmic protein tryosine phosphatase, SHP-2, to PD-1.
Figure 17B:
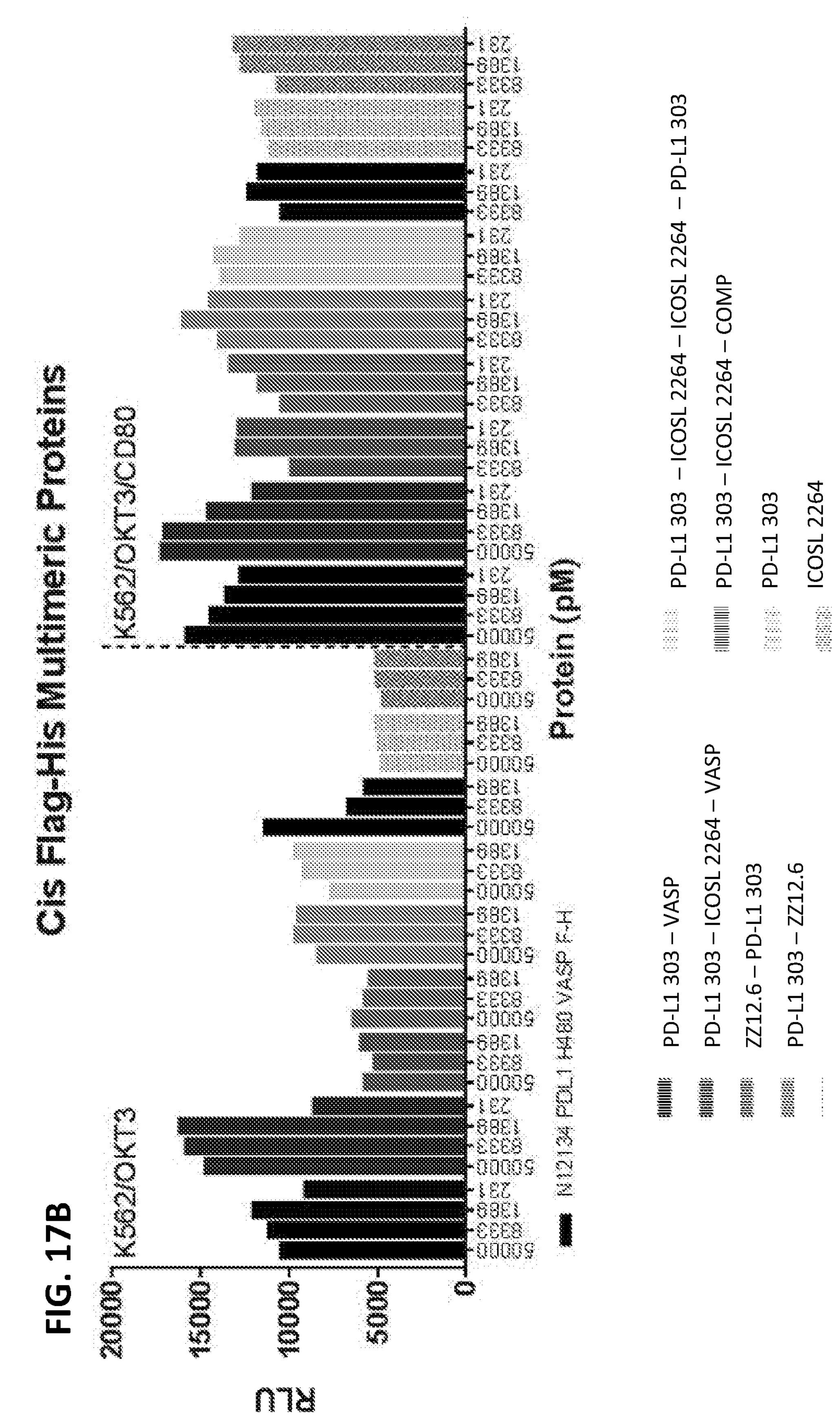
Figure 17C:
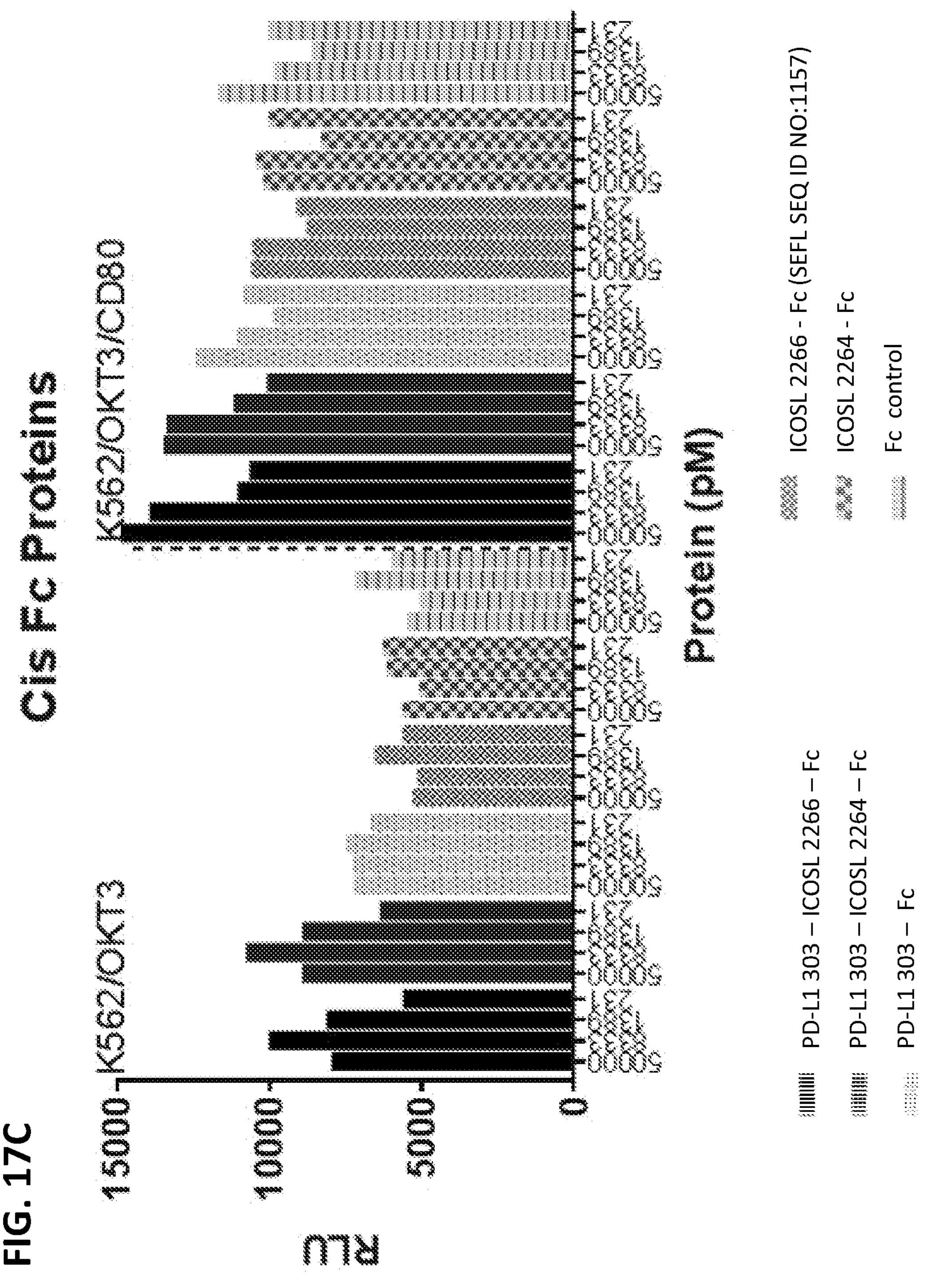

The Jurkat PD-1 SHP2 signaling assay was also used to assess additional exemplary monomeric or multimeric heterodimer PD-L1-ICOSL multi-domain immunomodulatory proteins. Jurkat/PD-1 cells were co-cultured with K562/OKT3 or K562/OKT3/CD80 aAPC and the tested immunomodulatory proteins. Exemplary multi-domain immunomodulatory proteins from Tables E3B, E4 and E5 were assessed including those as set forth in SEQ ID NO: 3500, 3501, 3502, 3507, 3513+3514, and 3515+3514. Individual ARBM or IRBM containing molecules were also assessed, including those with PD-L1 (SEQ ID NO: 303, 3506, 3525, 3533+3534), with ICOSL (SEQ ID NO: 3527, 3528), and with PD-L2 (SEQ ID NO:1417, 3533+3512). An Fc only control was also used. As shown in FIG. 17A-17C, some exemplary PD-L1-ICOSL multi-domain immunomodulatory proteins were observed to induce PD-1 signaling.

B. PD-L1/PD-L2-CTLA-4

Figure 18:
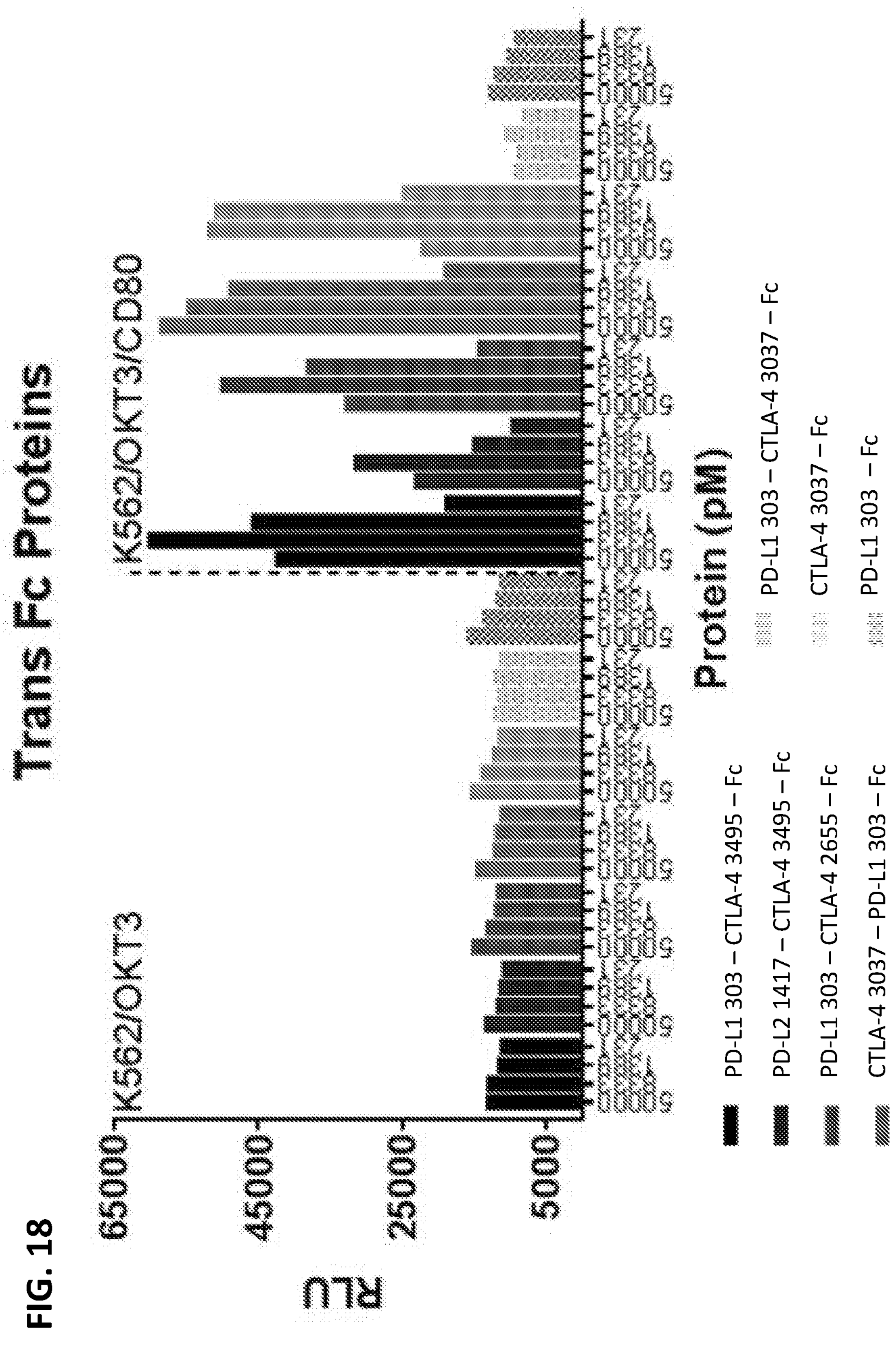
FIG. 18 shows results from a Jurkat PD-1 SHP2 Signaling Assay to assess the effect of monomeric or multimeric heterodimer PD-L1-CTLA-4 multi-domain immunomodulatory proteins to recruit the cytoplasmic protein tyrosine phosphatase, SHP-2, to PD-1.

The Jurkat PD-1 SHP2 signaling assay was also used to assess exemplary multi-domain immunomodulatory proteins from Table E2 including those set forth in SEQ ID NO:3518, 3519, 3521, 3522, and 3523. Jurkat/PD-1 cells were co-cultured with K562/OKT3/CD80 aAPC and the tested immunomodulatory proteins. In addition, control molecules including (1) variant PD-L1 IgV-Fc (SEQ ID NO:303), (2) variant PD-L2 IgV-Fc (SEQ ID NO:1417); (3) Fc only control, (4) variant CTLA-4 ECD-Fc: (SEQ ID NO: 3037), or (5) a wildtype human PD-L1-Fc were also tested. As shown in FIG. 18, the exemplary PD-L1-CTLA-4 multi-domain immunomodulatory proteins were observed to induce PD-1 signaling.

Example 8

Generation of Mutant DNA Constructs of IgSF Domains

Example 1 describes the generation of mutant DNA constructs of human CD155, CD112, PD-L1, PD-L2, CD86 (B7-2), CD80 (B7-1), ICOSL, and CTLA-4 IgSF domains for translation and expression on the surface of yeast as yeast display libraries.

A. Degenerate Libraries

Constructs were generated based on a wildtype human sequence set forth below:

PD-L1 IgV:

(SEQ ID NO: 309)
FTVTVPKDLYVVEYGSNMTIECKFPVEKQLDLAALI
VYWEMEDKNIIQFVHGEEDLKVQHSSYRQRARLL K
DQLSLGNAALQITDVKLQDAGVYRCMISYGGADYKR
ITVKVNA (SEQ ID NO: 55)
PKDLYVVEYGSNMTIECKFPVEKQLDLAALIVYWEM
EDKNIIQFVHGEEDLKVQHSSYRQRARLL KDQLSL
GNAALQITDVKLQDAGVYRCMISY GGADYKRITVK
V

PD-L2 IgV:

(SEQ ID NO: 1203)
FTVTVPKELYIIEHGSNVTLECNFDTGSHVNLGAIT
ASLQKVENDTSPHRERATLLEEQLPLGKASFHIPQV
QVRDEGQY QCIIIYGVAW DYKYLTLK (SEQ ID NO: 1263)
LFTVTVPKELYIIEHGSNVTLECNFDTGSHVNLGAI
TASLQKVENDTSPHRERATLLEEQLPLGKASFHIPQ
VQVRDEGQY QCIIIYGVAW DYKYLTLKVKA

CD155 IgV:

(SEQ ID NO: 310)
PGTGDVVVQAPTQVPGFLGDSVTLPCYLQVPNMEVT
HVSQLTWARHGESGSMAVFHQTQGPSYSESKRLEFV
AARLGAELRNASLRMFGLRVEDEGNYTCLFVTFPQG
SRSVDIWL (SEQ ID NO: 353)
WPPPGTGDVVVQAPTQVPGFLGDSVTLPCYLQVPNM
EVTHVSQLTWARHGESGSMAVFHQTQGPSYSESKRL

-continued

EFVAARLGAELRNASLRMFGLRVEDEGNYTCLFVTF
PQGSRSVDIWLRVL

CD112 IgV:

(SEQ ID NO: 666)
QDVRVQVLPEVRGQLGGTVELPCHLLPPVPGLYISL
VTWQRPDAPANHQNVAAFHPKMGPSFPSPKPGSERL
SFVSAKQSTGQDTEAELQDATLALHGLTVEDEGNYT
CEFATFPKGSVRGMTWL (SEQ ID NO: 761)
QDVRVQVLPEVRGQLGGTVELPCHLLPPVPGLYISLV
TWQRPDAPANHQNVAAFHPKMGPSFPSPKPGSERLS
FVSAKQSTGQDTEAELQDATLALHGLTVEDEGNYTC
EFATFPKGSVRGMTWLRV

CD86 IgV:

(SEQ ID NO: 29)
APLKIQAYFNETADLPCQFANSQNQSLSELVVFWQD
QENLVLNEVYLGKEKFDSVHSKYMGRTSFDSDSWTL
RLHNLQIKDKGLYQCIIHHKKPTGMIRIHQMNSELS
VLANFSQPEIVPISNITENVYINLTCSSIHGYPEPK
KMSVLLRTKNSTIEYDGVMQKSQDNVTELYDVSISL
SVSFPDVTSNMTIFCILETDKTRLLSSPFSIELEDP
QPPPDHIP (SEQ ID NO: 1195)
APLKIQAYFNETADLPCQFANSQNQSLSELVVFWQD
QENLVLNEVYLGKEKFDSVHSKYMGRTSFDSDSWTL
RLHNLQIKDKGLYQCIIHHKKPTGMIRIHQMNSELS

CD80 ECD or IgV:

(SEQ ID NO: 28)
VIHVTKEVKEVATLSCGHNVSVEELAQTRIYWQKEK
KMVLTMMSGDMNIWPEYKNRTIFDITNNLSIVILAL
RPSDEGTYECVVLKYEKDAFKREHLAEVTLSVKADF
PTPSISDFEIPTSNIRRIICSTSGGFPEPHLSWLEN
GEELNAINTTVSQDPETELYAVSSKLDFNMTTNHSF
MCLIKYGHLRVNQTFNWNTTKQEHFPDN (SEQ ID NO: 1005)
VIHVTKEVKEVATLSCGHNVSVEELAQTRIYWQKEK
KMVLTMMSGDMNIWPEYKNRTIFDITNNLSIVILAL
RPSDEGTYECVVLKYEKDAFKREHLAEVT (SEQ ID NO: 1079)
VIHVTKEVKEVATLSCGHNVSVEELAQTRIYWQKEK
KMVLTMMSGDMNIWPEYKNRTIFDITNNLSIVIQAL
RPSDEGTYECVVLKYEKDGFKREHLAEVTLSVKAD (SEQ ID NO: 2615)
VIHVTKEVKEVATLSCGHNVSVEELAQTRIYWQKEK
KMVLTMMSGDMNIWPEYKNRTIFDITNNLSIVIQAL
RPSDEGTYECVVLKYEKDGFKREHLAEVTLSVKADF

-continued (SEQ ID NO: 2654)
VIHVTKEVKEVATLSCGHNVSVEELAQTRIYWQKEK

KMVLTMMSGDMNIWPEYKNRTIFDITNNLSIVIQAL

RPSDEGTYECVVLKYEKDGFKREHLAEV (SEQ ID NO: 3580)
VIHVTKEVKEVATLSCGHNVSVEELAQTRIYWQKEK

KMVLTMMSGDMNIWPEYKNRTIFDITNNLSIVILAL

RPSDEGTYECVVLKYEKDAFKREHLAEVTLSVKAD

ICOSL ECD or IgV:
(SEQ ID NO: 32)
DTQEKEVRAMVGSDVELSCACPEGSRFDLNDVYVYW

QTSESKTVVTYHIPQNSSLENVDSRYRNRALMSPAG

MLRGDFSLRLFNVTPQDEQKFHCLVLSQSLGFQEVL

SVEVTLHVAANFSVPVVSAPHSPSQDELTFTCTSIN

GYPRPNVYWINKTDNSLLDQALQNDTVFLNMRGLYD

VVSVLRIARTPSVNIGCCIENVLLQQNLTVGSQTGN

DIGERDKITENPVSTGEKNAAT (SEQ ID NO: 2056)
DTQEKEVRAMVGSDVELSCACPEGSRFDLNDVYVYW

QTSESKTVVTYHIPQNSSLENVDSRYRNRALMSPAG

MLRGDFSLRLFNVTPQDEQKFHCLVLSQSLGFQEVL

SVE (SEQ ID NO: 2244)
DTQEKEVRAMVGSDVELSCACPEGSRFDLNDVYVYW

QTSESKTVVTYHIPQNSSLENVDSRYRNRALMSPAG

MLRGDFSLRLFNVTPQDEQKFHCLVLSQSLGFQEVL

SVEVTLHVAANFSV

CTLA-4 ECD:
(SEQ ID NO: 36)
KAMHVAQPAVVLASSRGIASFVCEYASPGKATEVRV

TVLRQADSQVTEVCAATYMMGNELTFLDDSICTGTS

SGNQVNLTIQGLRAMDTGLYICKVELMYPPPYYLGI

GNGTQIYVIDPEPCPDSD (SEQ ID NO: 2655)
KAMHVAQPAVVLASSRGIASFVCEYASPGKATEVRV

TVLRQADSQVTEVCAATYMMGNELTFLDDSICTGTS

SGNQVNLTIQGLRAMDTGLYICKVELMYPPPYYLGI

GNGTQIYVIDPEPCPDSDQ

For libraries that target specific residues for complete or partial randomization with degenerate codons, the DNA encoding the IgSF domains were ordered from Integrated DNA Technologies (Coralville, IA) as a set of overlapping oligonucleotides of up to 80 base pairs (bp) in length. To generate a library of diverse variants of the IgSF domains, the oligonucleotides contained desired degenerate codons, such as specific mixed base sets to code for various amino acid substitutions, were generated using an algorithm at the URL: rosettadesign.med.unc.edu/SwiftLib/.

In general, positions to mutate and degenerate codons were chosen from crystal structure information or homology models built from this structure containing the target-ligand pairs of interest to identify ligand contact residues, such as target side chain residues that interact with the ligand, as well as residues that are at the protein interaction interface. This analysis was performed using a structure viewer available at the URL: spdbv.vital-it.ch. For CD80, there are no CD80 structures available with ligands CD28 and PD-L1, so the same library was also used to select for binders of CD28 (binds the same region on CD80 as CTLA-4) and PD-L1 (not known if PD-L1 binds the same site as CTLA-4).

The next step in library design was the alignment of human, mouse, rat, and monkey sequences to identify which of the residues chosen for mutagenesis were conserved residues. Based on this analysis, conserved target residues were mutated with degenerate codons that only specified conservative amino acid changes plus the wild-type residue. Residues that were not conserved were mutated more aggressively, but also included the wild-type residue. Degenerate codons that also encoded the wild-type residue were deployed to avoid excessive mutagenesis of target protein. For the same reason, only up to 20 positions were targeted for mutagenesis for each library. Mutational analysis was focused on contact and non-contact interfacial residues that were within 6 Å of the binding surface with their side chains directed toward the ligand/counter structure.

To generate DNA encoding the targeted library, overlapping oligos of up to 80 nucleotides in length and containing degenerate codons at the residue positions targeted for mutagenesis, were ordered from Integrated DNA Technologies (Coralville, USA). The oligonucleotides were dissolved in sterile water, mixed in equimolar ratios, heated to 95° C. for five minutes and slowly cooled to room temperature for annealing. ECD or IgV domain-specific oligonucleotide primers that anneal to the start and end of the domain gene sequence were then used to generate PCR product. IgV domain-specific oligonucleotides which overlap by 40 bp with pBYDS03 cloning vector (Life Technologies, USA), beyond and including the BamHI and KpnI cloning sites, were then used to amplify 100 ng of PCR product from the prior step to generate a total of at least 12 μg of DNA for every electroporation. ECD-specific oligonucleotides which overlap by 40-50 bp with a modified version of pBYDS03 cloning vector (Life Technologies USA), beyond and including the BamH1 and KpnI cloning sites, were then used to amplify 100 ng of PCR product from the prior step to generate a total of at least 5 μg of DNA. Both polymerase chain reactions (PCRs) used OneTaq 2×PCR master mix (New England Biolabs, USA). The products from the second PCR were purified using a PCR purification kit (Qiagen, Germany) and resuspended in sterile deionized water. Alternatively, Ultramers® (Integrated DNA Technologies) of up to 200 bp in length were used in conjunction with megaprimer PCR (URL: http://www.ncbi.nlm.nih.gov/pmc/articles/PMC146891/pdf/253371.pdf) to generate larger stretches of degenerate codons that could not be as easily incorporated using multiple small overlapping primers. Following the generation of full length product using megaprimer PCR, the mutant IgV domain library was PCR amplified again using DNA primers containing 40 bp overlap region with pBYDS03 cloning variant for homologous recombination into yeast.

To prepare for library insertion, pBYDS03 vector was digested with BamHI and KpnI restriction enzymes (New England Biolabs, USA) and the large vector fragment was gel-purified and dissolved in sterile, deionized water. Electroporation-ready DNA for the next step was generated by mixing 12 μg of library DNA insert with 4 μg of linearized vector in a total volume of 50 μL deionized and sterile water.

An alternative method to generate targeted libraries is to carry out site-directed mutagenesis (Multisite kit, Agilent, USA) of the target IgV domain with oligonucleotides containing degenerate codons. This approach is used to generate sublibraries that only target a few specific stretches of DNA for mutagenesis. In these cases, sublibraries are mixed before proceeding to the selection steps. In general, library sizes were in the range of 10E7 to 10E8 clones, except that sublibraries were only in the range of 10E4 to 10E5.

B. Random Libraries

Random libraries were also constructed to identify variants of the various IgSF domains. DNA encoding the wild-type IgSF domain was cloned between the BamHI and KpnI sites of yeast display vector pBYDS03 and then released using the same restriction enzymes. The DNA was then mutagenized with the Genemorph II Kit (Agilent Genomics, USA) to generate an average of three to five amino acid changes per library variant. Mutagenized DNA was then amplified by the two-step PCR and further processed as described above for targeted libraries.

For some IgSF domains, after completing several rounds of selection using beads and iterative FACS, a pool of clones were further mutated via error prone PCR. Thus, a second generation mutant library was created for some domains following the steps outlined as above though using selection output DNA as template rather than wildtype IgV plasmid sequence as template.

Example 9

Introduction of DNA Libraries into Yeast

To introduce degenerate and random library DNA into yeast, electroporation-competent cells of yeast strain BJ5464 (ATCC.org; ATCC number 208288) were prepared and electroporated on a Gene Pulser II (Biorad, USA) with the electroporation-ready DNA from the steps above essentially as described (Colby, D. W. et al. 2004 Methods Enzymology 388, 348-358). The only exception was that transformed cells were grown in non-inducing minimal selective SCD-Leu medium to accommodate the LEU2 selective marker carried by modified plasmid pBYDS03. One liter of SCD-Leu media consists of 14.7 grams of sodium citrate, 4.29 grams of citric acid monohydrate, 20 grams of dextrose, 6.7 grams of yeast nitrogen base, and 1.6 grams yeast synthetic drop-out media supplement without leucine. The medium was filter sterilized before use, using a 0.22 μm vacuum filter device.

Library size was determined by plating dilutions of freshly recovered cells on SCD-Leu agar plates and then extrapolating library size from the number of single colonies from plating that generated at least 50 colonies per plate. The remainder of the electroporated culture was grown to saturation and cells from this culture were subcultured (e.g., 1/100) into the same medium once more and grown to saturation to minimize the fraction of untransformed cells and to allow for segregation of plasmid from cells that may contain two or more library variants. To maintain library diversity, this subculturing step was carried out using an inoculum that contained at least 10× more cells than the calculated library size. Cells from the second saturated culture were resuspended in fresh medium containing sterile 25% (weight/volume) glycerol to a density of 10E10/mL and frozen and stored at −80° C. (frozen library stock).

Example 10

Yeast Selection

Example 10 describes the selection of yeast cells expressing affinity-modified variants of CD155, CD112, PD-L1, PD-L2, CD80, CD86, ICOSL, and CTLA-4. Cells were processed to reduce non-binders and to enrich for CD155, CD112, PD-L1, PD-L2, CD80, CD86, ICOSL, and CTLA-4 variants with the ability to bind their exogenous recombinant counter-structure proteins.

A number of cells equal to at least 10 times the estimated library size were thawed from individual library stocks, suspended to 1.0×10E6 cells/mL in non-inducing SCD-Leu medium, and grown overnight. The next day, a number of cells equal to 10 times the library size were centrifuged at 2000 RPM for two minutes and resuspended to 0.5×10E6 cells/mL in inducing SCDG-Leu media. One liter of SCDG-Leu induction media consists of 5.4 grams $Na_2HPO_4$, 8.56 grams $NaH_2PO_4H_2O$, 20 grams galactose, 2.0 grams dextrose, 6.7 grams yeast nitrogen base, and 1.6 grams yeast synthetic drop out media supplement without leucine dissolved in water and sterilized through a 0.22 μm membrane filter device. The culture was grown in induction medium for 1 day at room temperature to induce expression of library proteins on the yeast cell surface.

Cells were sorted two to three times using Protein A magnetic beads (New England Biolabs, USA) loaded with cognate ligand to reduce non-binders and enrich for all variants with the ability to bind their exogenous recombinant counter-structure proteins. This was then followed by multiple rounds of fluorescence activated cell sorting (FACS) using exogenous counter-structure protein staining to enrich the fraction of yeast cells that displays improved binding (R&D Systems, USA). In some cases, these positive selections were alternated with negative FACS selections to remove clones that bound to other counter structure proteins. Magnetic bead enrichment and selections by flow cytometry were carried out essentially as described in Miller K. D., et al., Current Protocols in Cytometry 4.7.1-4.7.30, July 2008.

For CD155 variants provided in Table E10A, CD155 libraries were selected against each of TIGIT, CD96, and CD226, separately. For CD155 variants provided in Table E10B-E10F, selection involved two positive selections with the desired counter structures TIGIT and CD96 followed by one negative selection with the counter structure CD226 to select away from CD226 and improve binding specificity of the variant CD155. For selection, concentrations of the counter structures (TIGIT/CD96) and selection stringency of the positive sorts were varied to optimize lead identification. The concentration of CD226 for the negative selection was kept at 100 nM.

For CD112 variants provided in Table E11A, CD112 libraries were selected against each of TIGIT, CD112R, and CD226, separately. Target ligand proteins human rTIGIT.Fc (i.e., recombinant TIGIT-Fc fusion protein) and rCD226.Fc were purchased from R&D Systems (USA) and human rCD112R.Fc was made. Magnetic Protein A beads were obtained from New England Biolabs, USA. The EZ-Link™ Micro NHS-PEG4-Biotinylation Kit was used for biotinylation of counter-structure protein, (Life Technologies, USA). For additional CD112 variants provided in Table E11B-E11C, selection involved two positive selections with the desired counter structures TIGIT and CD112R followed by one negative selection with the counter structure CD226 to select away from CD226 and improve binding specificity of the variant CD112. Selection was performed essentially as described above except the concentrations of the counter structures (TIGIT/CD112R) and selection stringency of the positive sorts were varied to optimize lead identification. The concentration of CD226 for the negative selection was kept at 100 nM.

For PD-L1 and PD-L2 shown in Tables E12A-E12C or Tables E13A and E13B, respectively, yeast display targeted or random PD-L1 or PD-L2 libraries were selected against PD-1. With PD-L1 libraries, target ligand proteins were human rPD-1.Fc (i.e., recombinant PD-1-Fc fusion protein from R&D Systems, USA). With PD-L2 libraries, target ligand proteins was rhPD-1.Fc (i.e., recombinant human PD-1-Fc fusion protein from R&D Systems, USA). This was then followed by two to three rounds of flow cytometry sorting using exogenous counter-structure protein staining to enrich the fraction of yeast cells that displays improved binders. Ligand binding of Fc fusion protein to rPD-1.Fc, was detected with PE conjugated human Ig specific goat Fab (Jackson ImmunoResearch, USA). Alternatively, for PD-L1, selections were performed with human rCD80.Fc (i.e., human recombinant CD80 Fc fusion protein from R&D Systems, USA). Selections were carried out largely as described for PD-1 above. Magnetic bead enrichment and selections by flow cytometry are essentially as described in Miller, K. D., et al., Current Protocols in Cytometry 4.7.1-4.7.30, July 2008. PD-L1 variants in Table 22A-B were assessed for binding to cell-expressed counter structures. Additional PD-L1 variants identified in the screen as described above are set forth in Table 22C.

With CD80 and CD86 libraries, target ligand proteins were employed as follows: internally produced human rCTLA4-Fc, human rCD28-Fc, human rPD-L1 (R&D Systems, Minneapolis, USA), and rB7H6.Fc. Magnetic Protein A or streptavidin beads were obtained from New England Biolabs, USA. For biotinylation of counter-structure protein, biotinylation kit cat #21955, Life Technologies, USA, was used. For two-color, flow cytometric sorting, a Bio-Rad S3e sorter was used. CD80 display levels were monitored with an anti-hemagglutinin (HA) antibody labeled with Alexafluor 488 (Life Technologies, USA). Ligand binding of Fc fusion proteins, rCTLA4Fc, rPD-L1 or rCD28Fc, were detected with PE conjugated human Ig specific goat Fab (Jackson ImmunoResearch, USA). For CD80, the second FACS outputs (F2) were compared to parental CD80 yeast for binding rCTLA4Fc rPD-L1, or rCD28Fc by double staining each population with anti-HA (hemagglutinin) tag expression and the anti-human Fc secondary to detect ligand binding. CD80 variants are shown in Tables E14A-E14F.

For ICOSL shown in Tables E15A-E15F, yeast display targeted or random ICOSL libraries were selected against CTLA-4, CD28 and ICOS. Target ligand proteins were sourced from R&D Systems (USA) as follows: human rCD28.Fc (i.e., recombinant CD28-Fc fusion protein), rCTLA4.Fc and rICOS.Fc. The second sort outputs (F2) were compared to parental ICOSL yeast for binding of each rICOS.Fc, rCD28.Fc, and rCTLA4.Fc by double staining each population with anti-HA (hemagglutinin) tag expression and the anti-human Fc secondary to detect ligand binding. Importantly, the MFIs of all F2 outputs described above when measured with the anti-HA tag antibody on FL1 did not increase and sometimes went down compared to wild-type strains, indicating that increased binding was not a function of increased expression of the selected variants on the surface of yeast, and validated gating strategies of only selecting mid to low expressors with high ligand binding.

For CTLA-4 shown in Tables E16A-E16C, yeast display targeted or random libraries were selected against ICOSL and/or CD86. This selection process utilized the following reagents and instruments: human rICOSL.Fc (i.e., recombinant ICOSL-Fc fusion protein) and human rCD86.Fc target ligand proteins were purchased from R & D Systems, USA. The induced yeast library underwent 4 cycles of bead sorts using magnetic beads loaded alternately with ICOSL or CD86 to reduce non-binders and enrich for variant CTLA-4 molecules with the ability to bind ICOSL or CD86. After each cycle of selection, yeast retained through binding to magnetic beads were amplified through growth in SCD media followed by overnight induction in SCDG media. The preliminary selection was followed by two rounds of fluorescence activated cell sorting (FACS) using ICOSL-Fc in round 1 and CD86-Fc in round 2 to enrich the fraction of yeast cells that displays improved binders.

Doublet yeast were gated out using forward scatter (FSC)/side scatter (SSC) parameters, and sort gates were based upon higher ligand binding detected in FL2 that possessed more limited tag expression binding in FL1. For PD-L2, the second round FACS outputs (F2) were compared to parental for binding rPD-1.Fc by double staining each population with anti-HA (hemagglutinin) tag expression and the anti-human Fc-PE secondary to detect ligand binding.

Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

Selected variant IgSF domains were further formatted as fusion proteins and tested for binding and functional activity as described below.

Example 11

Reformatting Selection Outputs as Fc-Fusions and in Various Immunomodulatory Protein Types Example 11 describes reformatting of selection outputs identified in Example 10 as immunomodulatory proteins containing an affinity modified (variant) IgSF domain fused to an Fc molecule (variant IgV domain-Fc or ECD-Fc fusion molecules).

Output cell pools from final flow cytometric sorts were grown to terminal density in SCD-Leu medium. Plasmid DNA from each output was isolated using a yeast plasmid DNA isolation kit (ZymoResearch, USA). For PD-L2, the plasmid DNA was from at least 10× the number of cells of each sort output. For Fc fusions, PCR primers with added restriction sites suitable for cloning into the Fc fusion vector of choice were used to batch-amplify from the plasmid DNA preps the coding DNA for the mutant target IgV or ECD domains. After restriction digestion, the PCR products were ligated into Fc fusion vector followed by heat shock transformation into *E. coli* strain XL1 Blue (Agilent, USA) or NEB5alpha (New England Biolabs) as directed by supplier. Alternatively, the outputs were PCR amplified with primers containing 40 bp overlap regions on either end with Fc fusion vector to carry out in vitro recombination using Gibson Assembly Mastermix (New England Biolabs), which was subsequently used in heat shock transformation into *E.*

*coli* strain NEB5alpha. Exemplary of an Fc fusion vector is pFUSE-hIgG1-Fc2 (InvivoGen, USA).

Dilutions of transformation reactions were plated on LB-agar containing 100 μg/mL carbenicillin (Teknova, USA) to isolate single colonies for selection. Up to 96 colonies from each transformation were then grown in 96 well plates to saturation overnight at 37° C. in LB-carbenicillin broth (Teknova cat #L8112) and a small aliquot from each well was submitted for DNA sequencing of the IgV domain insert in order to identify the mutation(s) in all clones. Sample preparation for DNA sequencing was carried out using protocols provided by the service provider (Genewiz; South Plainfield, NJ). After removal of sample for DNA sequencing, glycerol was then added to the remaining cultures for a final glycerol content of 25% and plates were stored at −20° C. for future use as master plates (see below). Alternatively, samples for DNA sequencing were generated by replica plating from grown liquid cultures onto solid agar plates using a disposable 96 well replicator (VWR, USA). These plates were incubated overnight to generate growth patches and the plates were submitted to Genewiz as specified by Genewiz. In some instances, resequencing was performed to verify mutations.

After analysis of the Genewiz-generated DNA sequencing data, clones of interest were recovered from master plates and individually grown to density in liquid LB-broth containing 100 μg/mL carbenicillin (Teknova, USA) and cultures were then used for preparation of plasmid DNA of each clone using a standard kit such as the PureYield Plasmid Miniprep System (Promega) or the MidiPlus kit (Qiagen). Identification of clones of interest from Genewiz sequencing data generally involved the following steps. First, DNA sequence data files were downloaded from the Genewiz website. All sequences were then manually curated so that they start at the beginning of the ECD or IgV domain coding region. The curated sequences were then batch-translated using a suitable program available at the URL: www.ebi.ac.uk/Tools/st/emboss_transeq/. The translated sequences were then aligned using a suitable program available at the URL: multalin.toulouse.inra.fr/multalin/multalin.html. Alternatively, Genewiz sequences were processed to generate alignments using Ugene software (http://ugene.net).

Clones of interest were then identified from alignments using the following criteria: 1) identical clone occurs at least two times in the alignment and 2) a mutation occurs at least two times in the alignment and preferably in distinct clones. Clones that meet at least one of these criteria were assumed to be clones that have been enriched by the sorting process due to improved binding.

To generate recombinant immunomodulatory proteins that are Fc fusion proteins containing an IgV domain or ECD of the various IgSF proteins with at least one affinity-modified domain, the DNA encoding the variant was generated to encode a protein as follows: variant (mutant) ECD or IgV domain followed by a linker of three alanines (AAA) followed by an inert Fc lacking effector function, set forth in SEQ ID NO: 1938, containing the mutations C220S, R292C, N297G and V302C by EU numbering (corresponding to C5S, R77C, N82G and V87C with reference to wild-type human IgG1 Fc set forth in SEQ ID NO: 187); or 1939, containing the mutations C220S, L234A, L235E and G237A by EU numbering. In some cases, the encoding DNA was generated to encode a protein as follows: variant (mutant) IgV domain followed by a linker of three alanines (AAA) followed by a human IgG1 Fc set forth in SEQ ID NO: 1157 containing the mutations R292C, N297G and V302C by EU numbering (corresponding to R77C, N82G and V87C with reference to wild-type human IgG1 Fc set forth in SEQ ID NO: 187).

Alternatively, ECD or IgV domains were fused in a similar manner but with a linker containing the amino acids (GSGGGGS; SEQ ID NO: 1941) followed by an inert Fc lacking effector function, set forth in SEQ ID NO: 1939. In some cases, the NotI cloning site which contributes to the AAA linker sequence was deleted to generate a direct fusion of the ICOSL ECD and the beginning of the Fc. In some cases, ECD or IgV domains were fused in a similar manner but with a human IgG1 Fc capable of effector activity (effector). Since the construct does not include an antibody, light chains that can form a covalent bond with a cysteine, such an exemplary human IgG1 Fc (set forth in SEQ ID NO: 1202) contained a replacement of the cysteine residue to a serine residue at position 220 (C220S) by EU numbering (corresponding to position 5 (C5S) with reference to the wild-type or unmodified Fc set forth in SEQ ID NO: 187).

Example 12

Expression and Purification of Fc-Fusions

Example 12 describes the high throughput expression and purification of Fc-fusion proteins containing variant ECD or IgV domains as described in the above Examples.

Recombinant variant Fc fusion proteins were produced from suspension-adapted human embryonic kidney (HEK) 293 cells using the Expi293 expression system (Invitrogen, USA). 4 μg of each plasmid DNA from the previous step was added to 200 μL Opti-MEM (Invitrogen, USA) at the same time as 10.8 μL ExpiFectamine was separately added to another 200 μL Opti-MEM. After 5 minutes, the 200 μL of plasmid DNA was mixed with the 200 μL of ExpiFectamine and was further incubated for an additional 20 minutes before adding this mixture to cells. Ten million Expi293 cells were dispensed into separate wells of a sterile 10 mL, conical bottom, deep 24-well growth plate (Thomson Instrument Company, USA) in a volume of 4 mL Expi293 media (Invitrogen, USA). Plates were shaken for 5 days at 120 RPM in a mammalian cell culture incubator set to 95% humidity and 8% $CO_2$. Following a 5-day incubation, cells were pelleted and culture supernatants were retained.

In general, proteins were purified from supernatants using a high throughput 96-well Filter Plate (Thomson Catalog number 931919), each well loaded with 60 μL of Mab SelectSure settled bead (GE Healthcare cat. no. 17543801). Protein was eluted with four consecutive 200 μl fractions of 50 mM Acetate pH 3.3. Each fraction's pH was adjusted to above pH 5.0 with 4 μL 2 M Tris pH 8.0. Fractions were pooled and quantitated using 280 nm absorbance measured by Nanodrop instrument (Thermo Fisher Scientific, USA), and protein purity was assessed by loading 5 μg of non-reduced protein on Mini-Protean TGX Stain-Free gels. Proteins were then visualized on a Bio Rad Chemi Doc XRS gel imager.

In some cases, proteins were purified from supernatants using a high throughput 96 well Protein A purification kit using the manufacturer's protocol (Catalog number 45202, Life Technologies, USA). Resulting elution fractions were buffer exchanged into PBS using Zeba 96 well spin desalting plate (Catalog number 89807, Life Technologies, USA) using the manufacturer's protocol. Purified protein was quantitated using 280 nm absorbance measured by Nanodrop instrument (Thermo Fisher Scientific, USA), and protein purity was assessed by loading 5 μg of protein on NUPAGE pre-cast, polyacrylamide gels (Life Technologies, USA) under denaturing and reducing conditions and subsequent gel electrophoresis. Proteins were visualized in gel using standard Coomassie staining.

Example 13

Assessment of Binding of Affinity-Matured IgSF Domain-Containing Molecules

This Example describes Fc-fusion binding studies of purified affinity modified CD155, CD112, PD-L1, PD-L2, CD86 (B7-2), CD80 (B7-1), ICOSL, and CTLA-4 proteins, which are other components of the immune synapse (IS) that have a demonstrated dual role in both immune activation and inhibition. The binding of the proteins to cell-expressed counter structures was tested to assess the specificity and affinity of IgSF domain variant immunomodulatory proteins. These examples demonstrate that affinity modification of IgSF domains yields proteins that can act to both increase and decrease immunological activity. Various combinations of those domains as the ARBM or IRBM in the multi-domain immunomodulatory protein can be used to achieve immunomodulatory activity.

A. Binding to Cell-Expressed Counter Structures

To produce cells expressing cognate binding partners, full-length mammalian surface expression constructs for the binding partners were designed in pcDNA3.1 expression vector (Life Technologies) and sourced from Genscript, USA. Binding studies were carried out on transfected HEK293 cells generated to express the full-length mammalian surface ligands using the using the Expi293F transient transfection system (Life Technologies, USA). As a control, binding to mock (non-transfected) cells also was assessed. The number of cells needed for the experiment was determined, and the appropriate 30 mL scale of transfection was performed using the manufacturer's suggested protocol. For each binding partner protein or mock 30 mL transfection, 75 million Expi293F cells were incubated with 30 μg expression construct DNA and 1.5 mL diluted ExpiFectamine 293 reagent for 48 hours, at which point cells were harvested for staining.

For staining and analysis by flow cytometry, 100,000-200,000 cells of appropriate transient transfection or negative control (mock) were plated in 96-well round bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged and resuspended in staining buffer containing 200 nM to 91 pM of each candidate variant protein, depending on the experiment of each candidate variant Fc protein in 50 μl. As controls, the binding activities of wild-type Fc fusion proteins and/or human IgG (Sigma) were also assessed. Primary staining was performed on ice for 45 minutes, before washing cells in staining buffer twice. PE-conjugated anti-human Fc (Jackson ImmunoResearch, USA) was diluted 1:150 in 50 μL staining buffer and added to cells and incubated another 30 minutes on ice. Secondary antibody was washed out twice, cells were fixed in 4% formaldehyde/PBS, and samples were analyzed on Intellicyt flow cytometer (Intellicyt Corp, USA) or FACScan flow cytometer (Becton Dickinson, USA). Mean Fluorescence Intensity (MFI) was calculated for each transfectant and mock transfected HEK293 with FlowJo Version 10 software (FlowJo LLC, USA).

Mean Fluorescence Intensity (MFI) was calculated for each transfectant and negative parental line with Cell Quest Pro software (Becton Dickinson, USA). A ratio of the MFI value of the tested variant compared to the parental (WT) MFI value was also calculated.

For each Table, the exemplary amino acid substitutions are designated by amino acid position number corresponding to the respective reference unmodified ECD sequence. The amino acid position is indicated in the middle, with the corresponding unmodified (e.g. wild-type) amino acid listed before the number and the identified variant amino acid substitution listed (or inserted designated by a) after the number.

Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding unmodified Fc fusion molecule not containing the amino acid substitution(s) to the same cell-expressed counter structure ligand.

B. Anti-CD3 Coimmobilization Assay

Costimulatory bioactivity for some of the fusion variants was determined in anti-CD3 coimmobilization assays. 1 nM or 4 nM mouse anti-human CD3 (OKT3, Biolegends, USA) was diluted in PBS with 1 nM to 80 nM of the variant proteins. This mixture was added to tissue culture treated flat bottom 96 well plates (Corning, USA) overnight to facilitate adherence of the stimulatory proteins to the wells of the plate. The next day, unbound protein was washed off the plates and 100,000 purified human pan T cells (BenTech Bio, US) or human T cell clone BC3 (Astarte Biologics, USA) were added to each well in a final volume of 200 μL of Ex-Vivo 15 media (Lonza, Switzerland). Cells were cultured 3 days before harvesting culture supernatants and measuring human IFN-gamma levels with Duoset ELISA kit (R&D Systems, USA) as mentioned above.

C. Bioactivity Characterization

Bioactivity was also tested in a human Mixed Lymphocyte Reaction (MLR) for some molecules. Human primary dendritic cells (DC) are generated by culturing monocytes isolated from PBMC (BenTech Bio, USA) in vitro for 7 days with 500U/mL rIL-4 (R&D Systems, USA) and 250 U/mL rGM-CSF (R&D Systems, USA) in Ex-Vivo 15 media (Lonza, Switzerland). 10,000 matured DC and 100,000 purified allogeneic CD4+ T cells (BenTech Bio, USA) are co-cultured with variant Fc fusion proteins and controls in 96 well round bottom plates in 200 μL final volume of Ex-Vivo 15 media. On day 5, IFN-gamma secretion in culture supernatants is analyzed using the Human IFN-gamma Duoset ELISA kit (R&D Systems, USA). Optical density is measured by VMax ELISA Microplate Reader (Molecular Devices, USA) and quantitated against titrated rIFN-gamma standard included in the IFN-gamma Duo-set kit (R&D Systems, USA).

The functional activity of the some variant Fc-fusion molecules to modulate the activity of T cells also is shown based on the calculated levels of IFN-gamma in culture supernatants (pg/mL) generated with the indicated variant Fc fusion molecule in an MLR assay. Tables E10A, E11A, E13B, E14E-F, E15A-F, E16A-C also depict the ratio of IFN-gamma produced by each variant IgV-Fc compared to the corresponding unmodified IgV-Fc in an MLR assay.

D. Binding and Bioactivity Data

As shown, the selections resulted in the identification of a number of CD155, CD112, PD-L1, PD-L2, CD86 (B7-2), CD80 (B7-1), ICOSL, and CTLA-4 IgSF domain variants that were affinity-modified to exhibit increased binding for at least one, and in some cases more than one, cognate counter structure ligand. In addition, the results showed that affinity modification of the variant molecules also exhibited improved activities to both increase and decrease immunological activity.

1. CD155 Binding and Bioactivity Data

Purified variant IgV Fc fusion proteins were tested to assess specificity and affinity of CD155 domain variant immunomodulatory proteins for cognate binding partners as described above using HEK293 cells expressing the full-length mammalian surface expression constructs for human TIGIT, CD226 or CD96. For some molecules, soluble rCD155.Fc bioactivity was also tested in a human Mixed Lymphocyte Reaction (MLR).

TABLE E10A

Variant CD155 selected against cognate binding partners. Molecule sequences, binding data, and costimulatory bioactivity data.

| CD155 mutations | CD226 tfxn MFI (CD226 MFI parental ratio) | TIGIT tfxn MFI (TIGIT MFI parental ratio) | CD96 MFI (CD96 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|
| P18S, P64S, F91S | 497825 (133.7) | 247219 (91.1) | 140065 (45.4) | 3528 (1.2) | 270.1 (0.7) |
| P18S, F91S, L104P | 26210 (7.0) | 75176 (27.7) | 10867 (3.5) | 2130 (0.7) | 364.2 (0.9) |
| L44P | 581289 (156.1) | 261931 (96.5) | 152252 (49.4) | 3414 (1.2) | 277.6 (0.7) |
| A56V | 455297 (122.3) | 280265 (103.2) | 161162 (52.2) | 2601 (0.9) | 548.2 (1.4) |
| P18L, L79V, F91S | 5135 (1.4) | 4073 (1.5) | 3279 (1.1) | 2719 (0.9) | 1241.5 (3.2) |
| P18S, F91S | 408623 (109.8) | 284190 (104.7) | 147463 (47.8) | 3348 (1.1) | 760.6 (2.0) |
| P18T, F91S | 401283 (107.8) | 223985 (82.5) | 157644 (51.1) | 3065 (1.1) | 814.7 (2.1) |
| P18T, S42P, F91S | 554105 (148.8) | 223887 (82.5) | 135395 (43.9) | 3796 (1.3) | 539.7 (1.4) |
| G7E, P18T, Y30C, F91S | 12903 (3.5) | 12984 (4.8) | 7906 (2.6) | 2671 (0.9) | 275.9 (0.7) |
| P18T, F91S, G111D | 438327 (117.7) | 287315 (105.8) | 167583 (54.3) | 4012 (1.4) | 307.2 (0.8) |
| P18S, F91P | 4154 (1.1) | 3220 (1.2) | 2678 (0.9) | 2816 (1.0) | 365.7 (0.9) |
| P18T, F91S, F108L | 394546 (106.0) | 298680 (110.0) | 193122 (62.6) | 2926 (1.0) | 775.4 (2.0) |
| P18T, T45A, F91S | 435847 (117.1) | 222044 (81.8) | 191026 (61.9) | 2948 (1.0) | 1546.8 (4.0) |
| P18T, F91S, R94H | 3589 (1.0) | 2942 (1.1) | 2509 (0.8) | 2390 (0.8) | 1273.2 (3.3) |
| P18S, Y30C, F91S | 382352 (102.7) | 276358 (101.8) | 56934 (18.5) | 3540 (1.2) | 426.5 (1.1) |
| A81V, L83P | 4169 (1.1) | 2912 (1.1) | 2616 (0.8) | 2993 (1.0) | 339.7 (0.9) |
| L88P | 65120 (17.5) | 74845 (27.6) | 35280 (11.4) | 2140 (0.7) | 969.2 (2.5) |
| Wild type | 3723 (1.0) | 2715 (1.0) | 3085 (1.0) | 2913 (1.0) | 389.6 (1.0) |
| R94H | 18905 (5.1) | 104013 (38.3) | 11727 (3.8) | 1663 (0.6) | 372.6 (1.0) |
| ABE, P18S, A56V, F91S | 357808 (96.1) | 179060 (66.0) | 118570 (38.4) | 2844 (1.0) | 349.2 (0.9) |
| P18T, F91S, V115A | 38487 (10.3) | 46313 (17.1) | 22718 (7.4) | 2070 (0.7) | 1574.5 (4.0) |
| P18T, Q60K | 238266 (64.0) | 173730 (64.0) | 154448 (50.1) | 4778 (1.6) | 427.2 (1.1) |

TABLE E10B

Additional CD155 Variants and Binding Data.

| CD155 Mutation(s) | TIGIT MFI at (100 nM) | TIGIT Fold ↑ to WT ECD | CD226 MFI at (100 nM) | CD226 Fold ↑ to WT ECD | CD112R MFI at (100 nM) | CD112R Fold ↑ to WT ECD | CD96 MFI at (100 nM) | CD96 Fold ↑ to WT ECD |
|---|---|---|---|---|---|---|---|---|
| S52M | 1865.3 | 0.00 | 1901.0 | 0.01 | 1553.4 | 0.87 | 1609.8 | 0.02 |
| T45Q, S52L, L104E, G111R | 2287.0 | 0.01 | 2390.4 | 0.01 | 1735.1 | 0.97 | 1575.1 | 0.02 |
| S42G | 4837.5 | 0.01 | 2448.1 | 0.01 | 1815.4 | 1.02 | 1699.6 | 0.02 |
| Q62F | 2209.5 | 0.01 | 2572.1 | 0.01 | 2706.5 | 1.52 | 2760.7 | 0.03 |
| S52Q | 2288.1 | 0.01 | 2022.3 | 0.01 | 1790.1 | 1.00 | 1822.3 | 0.02 |
| S42A, L104Q, G111R | 1923.7 | 0.00 | 1901.7 | 0.01 | 1815.1 | 1.02 | 1703.8 | 0.02 |
| S42A, S52Q, L104Q, G111R | 1807.5 | 0.00 | 2157.2 | 0.01 | 1894.4 | 1.06 | 1644.0 | 0.02 |
| S52W, L104E | 1938.2 | 0.00 | 1905.6 | 0.01 | 2070.6 | 1.16 | 1629.5 | 0.02 |
| S42C | 1914.0 | 0.00 | 2096.1 | 0.01 | 1685.0 | 0.95 | 1592.4 | 0.02 |
| S52W | 1991.6 | 0.00 | 2037.3 | 0.01 | 1612.8 | 0.90 | 1712.9 | 0.02 |
| S52M, L104Q | 2666.6 | 0.01 | 2252.2 | 0.01 | 1706.0 | 0.96 | 1633.1 | 0.02 |
| S42L, S52L, Q62F, L104Q | 2021.4 | 0.00 | 2643.8 | 0.02 | 1730.1 | 0.97 | 2318.7 | 0.02 |
| S42W | 2434.5 | 0.01 | 2133.4 | 0.01 | 2325.7 | 1.30 | 2555.4 | 0.03 |
| S42Q | 2073.5 | 0.00 | 2225.9 | 0.01 | 1905.1 | 1.07 | 2143.1 | 0.02 |
| S52L | 2224.8 | 0.01 | 2676.3 | 0.02 | 2038.6 | 1.14 | 2043.2 | 0.02 |
| S52R | 4395.4 | 0.01 | 3964.4 | 0.02 | 2741.7 | 1.54 | 4846.9 | 0.05 |
| L104E | 3135.4 | 0.01 | 2264.2 | 0.01 | 1803.5 | 1.01 | 1556.7 | 0.02 |
| G111R | 2082.7 | 0.00 | 2791.3 | 0.02 | 2470.9 | 1.39 | 3317.1 | 0.03 |
| S52E | 2655.4 | 0.01 | 2599.8 | 0.02 | 1904.9 | 1.07 | 1799.0 | 0.02 |
| Q62Y | 2528.6 | 0.01 | 2621.4 | 0.02 | 1918.4 | 1.08 | 1827.5 | 0.02 |
| T45Q, S52M, L104E | 79498.2 | 0.19 | 143238.5 | 0.83 | 2600.6 | 1.46 | 6310.4 | 0.06 |
| S42N, L104Q, G111R | 2432.1 | 0.01 | 2311.3 | 0.01 | 1847.4 | 1.04 | 1958.3 | 0.02 |
| S52M, V57L | 1760.7 | 0.00 | 2431.6 | 0.01 | 2006.9 | 1.13 | 1858.7 | 0.02 |
| S42N, S52Q, Q62F | 2402.7 | 0.01 | 2152.0 | 0.01 | 1855.0 | 1.04 | 1737.6 | 0.02 |
| S42A, S52L, L104E, G111R | 2262.7 | 0.01 | 1889.4 | 0.01 | 1783.2 | 1.00 | 1606.2 | 0.02 |
| S42W, S52Q, V57L, Q62Y | 1961.4 | 0.00 | 2138.3 | 0.01 | 1844.9 | 1.03 | 1699.6 | 0.02 |
| L104Q | 10314.4 | 0.02 | 3791.4 | 0.02 | 2119.9 | 1.19 | 1542.6 | 0.02 |
| S42L, S52Q, L104E | 1946.9 | 0.00 | 6474.3 | 0.04 | 1749.0 | 0.98 | 1702.2 | 0.02 |
| S42C,S52L | 1762.5 | 0.00 | 2147.3 | 0.01 | 1663.4 | 0.93 | 1484.7 | 0.01 |
| S42W, S52R, Q62Y, L104Q | 1918.8 | 0.00 | 2300.1 | 0.01 | 1824.6 | 1.02 | 1756.0 | 0.02 |
| T45Q, S52R, L104E | 121636.9 | 0.29 | 142381.2 | 0.82 | 2617.9 | 1.47 | 3748.2 | 0.04 |
| S52R, Q62F, L104Q, G111R | 2969.2 | 0.01 | 3171.6 | 0.02 | 1725.4 | 0.97 | 2362.3 | 0.02 |
| T45Q, S52L, V57L, L104E | 2857.7 | 0.01 | 5943.5 | 0.03 | 1496.8 | 0.84 | 1533.3 | 0.02 |
| S52M, Q62Y | 1926.6 | 0.00 | 2000.3 | 0.01 | 1771.6 | 0.99 | 1651.1 | 0.02 |
| Q62F, L104E, G111R | 1966.4 | 0.00 | 2043.5 | 0.01 | 1701.9 | 0.95 | 1524.8 | 0.02 |
| T45Q, S52Q | 4812.8 | 0.01 | 5787.5 | 0.03 | 1765.6 | 0.99 | 2451.3 | 0.02 |
| S52L, L104E | 4317.8 | 0.01 | 2213.9 | 0.01 | 1756.9 | 0.99 | 1829.3 | 0.02 |
| S42V, S52E | 2055.0 | 0.00 | 2272.6 | 0.01 | 1808.0 | 1.01 | 2530.2 | 0.03 |
| T45Q, S52R, G111R | 4092.3 | 0.01 | 2075.2 | 0.01 | 1793.6 | 1.01 | 2336.6 | 0.02 |
| S42G, S52Q, L104E, G111R | 2010.1 | 0.00 | 2019.2 | 0.01 | 1706.4 | 0.96 | 1707.6 | 0.02 |
| S42N, S52E, V57L, L104E | 1784.2 | 0.00 | 1743.6 | 0.01 | 1690.1 | 0.95 | 1538.7 | 0.02 |
| Wildtype | 1964.7 | 0.00 | 2317.1 | 0.01 | 2169.6 | 1.22 | 1893.4 | 0.02 |
| S42C, S52M, Q62F | 1861.0 | 0.00 | 2084.2 | 0.01 | 1592.3 | 0.89 | 1481.3 | 0.01 |
| S42L | 1930.4 | 0.00 | 2187.2 | 0.01 | 1743.2 | 0.98 | 1618.4 | 0.02 |
| Wildtype | 2182.6 | 0.01 | 2374.5 | 0.01 | 1743.1 | 0.98 | 1680.4 | 0.02 |
| S42A | 1929.2 | 0.00 | 2188.6 | 0.01 | 1733.7 | 0.97 | 1623.6 | 0.02 |
| S42G, S52L, Q62F, L104Q | 1924.3 | 0.00 | 2157.6 | 0.01 | 1661.3 | 0.93 | 1642.1 | 0.02 |
| S42N | 1817.4 | 0.00 | 1910.9 | 0.01 | 1699.7 | 0.95 | 1691.5 | 0.02 |
| CD155 IgV Fc | 4690 | 0.01 | 4690 | 0.03 | 2941 | 1.65 | 3272 | 0.03 |
| Wildtype CD 155 ECD-Fc | 423797 | 1.00 | 172839 | 1.00 | 1783 | 1.00 | 99037 | 1.00 |

TABLE E10B-continued

| Additional CD155 Variants and Binding Data. | | | | | | | | |
|---|---|---|---|---|---|---|---|---|
| | TIGIT | | CD226 | | CD112R | | CD96 | |
| CD155 Mutation(s) | MFI at (100 nM) | Fold ↑ to WT ECD | MFI at (100 nM) | Fold ↑ to WT ECD | MFI at (100 nM) | Fold ↑ to WT ECD | MFI at (100 nM) | Fold ↑ to WT ECD |
| Anti-human Fc PE | 1506.3 | 0.00 | 3774 | 0.02 | 1587 | 0.89 | 1618 | 0.02 |

TABLE E10C

| Additional CD155 Variants and Binding Data. | | | | | | |
|---|---|---|---|---|---|---|
| | TIGIT | | CD226 | | CD96 | |
| CD155 Mutation(s) | MFI at 100 nM | Fold Increase to WT ECD | MFI at 100 nM | Fold Increase to WT ECD | MFI at 100 nM | Fold Increase to WT ECD |
| P18T, S65A, S67V, F91S | 297843 | 1.99 | 351195 | 3.22 | 128180 | 1.68 |
| P18T, T45Q, T61R, S65N, S67L | 224682 | 1.50 | 270175 | 2.48 | 22820 | 0.30 |
| P18F, S65A, S67V, F91S | 534106 | 3.57 | 350410 | 3.21 | 144069 | 1.89 |
| P18S, L79P, L104M | 342549 | 2.29 | 320823 | 2.94 | 107532 | 1.41 |
| P18S, L104M | 449066 | 3.00 | 295126 | 2.70 | 121266 | 1.59 |
| L79P, L104M | 3210 | 0.02 | 8323 | 0.08 | 2894 | 0.04 |
| P18T, T45Q, L79P | 542878 | 3.63 | 371498 | 3.40 | 193719 | 2.55 |
| P18T, T45Q, T61R, S65H, S67H | 312337 | 2.09 | 225439 | 2.07 | 152903 | 2.01 |
| A13R, D23Y, E37P, S42P, Q62Y, A81E | 4161 | 0.03 | 11673 | 0.11 | 5762 | 0.08 |
| P18L, E37S, Q62M, G80S, A81P, G99Y, S112N | 5900 | 0.04 | 14642 | 0.13 | 3345 | 0.04 |
| P18S, L104T | 321741 | 2.15 | 367470 | 3.37 | 108569 | 1.43 |
| P18S, Q62H, L79Q, F91S | 283357 | 1.89 | 324877 | 2.98 | 125541 | 1.65 |
| P18S, F91S | 222780 | 1.49 | 300049 | 2.75 | 48542 | 0.64 |
| P18L, V57T, T61S, S65Y, S67A, L104T | 278178 | 1.86 | 276870 | 2.54 | 121499 | 1.60 |
| P18T, T45Q | 326769 | 2.18 | 357515 | 3.28 | 92389 | 1.21 |
| T61M, S65W, S67A, L104T | 360915 | 2.41 | 417897 | 3.83 | 148954 | 1.96 |
| P18S, V41A, S42G, T45G, L104N | 3821 | 0.03 | 11449 | 0.10 | 3087 | 0.04 |
| P18H, S42G, T45I, S52T, G53R, S54H, V57L, H59E, T61S, S65D, E68G, L104N | 5066 | 0.03 | 177351 | 1.63 | 3700 | 0.05 |
| P18S, S42G, T45V, F58L, S67W, L104N | 14137 | 0.09 | 15175 | 0.14 | 15324 | 0.20 |
| P18S, T45I, L104N | 141745 | 0.95 | 298011 | 2.73 | 97246 | 1.28 |
| P18S, S42G, T45G, L104N, V106A | 29387 | 0.20 | 117965 | 1.08 | 15884 | 0.21 |
| P18H, H40R, S42G, T45I, S52T, G53R, S54H, V57L, H59E, T61S, S65D, E68G, L104Y, V106L, F108H | 12335 | 0.08 | 14657 | 0.13 | 15779 | 0.21 |
| P18S, T45Q, L79P, L104T | 206674 | 1.38 | 285512 | 2.62 | 87790 | 1.15 |
| P18L, Q62R | 66939 | 0.45 | 25063 | 0.23 | 10928 | 0.14 |
| P18L, H49R, L104T, D116N | 167980 | 1.12 | 214677 | 1.97 | 62451 | 0.82 |
| S65T, L104T | 205942 | 1.38 | 187147 | 1.71 | 65207 | 0.86 |
| P18L, A47V, Q62Y, E73D, L104T | 146142 | 0.98 | 248926 | 2.28 | 73956 | 0.97 |
| P18L, S42P, T45Q, T61G, S65H, S67E, L104T, D116N | 153536 | 1.03 | 402503 | 3.69 | 53044 | 0.70 |
| T45Q, S52E, Q62F, L104E | 132850 | 0.89 | 276434 | 2.53 | 14558 | 0.19 |
| Wildtype CD155 ECD-Fc | 149692 | 1.00 | 109137 | 1.00 | 76083 | 1.00 |
| Anti-human Fc PE | 2287 | 0.02 | 4799 | 0.04 | 2061 | 0.03 |

TABLE E10D

| Additional CD155 Variants and Binding Data. | | | | | | |
|---|---|---|---|---|---|---|
| | TIGIT | | CD226 | | CD96 | |
| CD155 Mutations | MFI at 100 nM | Fold Increase to WT IgV | MFI at 100 nM | Fold Increase to WT IgV | MFI at 100 nM | Fold Increase to WT IgV |
| P18F, T26M, L44V, Q62K, L79P, F91S, L104M, G111D | 117327 | 1.2 | 1613 | 0.1 | 1629 | 0.1 |
| P18S, T45S, T61K, S65W, S67A, F91S, G111R | 124936 | 1.3 | 2114 | 0.1 | 2223 | 0.1 |
| P18S, L79P, L104M, T107M | 110512 | 1.1 | 18337 | 0.9 | 22793 | 1.3 |
| P18S, S65W, S67A, M90V, V95A, L104Q, G111R | 101726 | 1.0 | 1605 | 0.1 | 2571 | 0.1 |
| Wildtype CD155-ECD | 98935 | 1.0 | 20029 | 1.0 | 17410 | 1.0 |

TABLE E10E

Additional CD155 Variants and Binding Data.

| CD155 Mutations | TIGIT MFI at 11.1 nM | TIGIT Fold Change from CD155-ECD | CD226 MFI at 11.1 nM | CD226 Fold Change from CD155-ECD | CD96 MFI at 11.1 nM | CD96 Fold Change from CD155-ECD |
|---|---|---|---|---|---|---|
| P18S, A47G, L79P, F91S, L104M, T107A, R113W | 56,409 | 1.19 | 1,191 | 0.08 | 25,362 | 1.49 |
| P18T, D23G, S24A, N35D, H49L, L79P, F91S, L104M, G111R | 128,536 | 2.72 | 987 | 0.06 | 3,497 | 0.20 |
| V9L, P18S, Q60R, V75L, L79P, R89K, F91S, L104E, G111R | 125,329 | 2.65 | 986 | 0.06 | 959 | 0.06 |
| P18S, H49R, E73D, L79P, N85D, F91S, V95A, L104M, G111R | Little to no protein produced | | | | | |
| V11A, P18S, L79P, F91S, L104M, G111R | 48,246 | 1.02 | 974 | 0.06 | 923 | 0.05 |
| V11A, P18S, S54R, Q60P, Q62K, L79P, N85D, F91S, T107M | 190,392 | 4.02 | 1,019 | 0.07 | 1,129 | 0.07 |
| P18T, S52P, S65A, S67V, L79P, F91S, L104M, G111R | 121,611 | 2.57 | 986 | 0.06 | 16,507 | 0.97 |
| P18T, M36T, L79P, F91S, G111R | 150,015 | 3.17 | 1,029 | 0.07 | 2,514 | 0.15 |
| D8G, P18S, M36I, V38A, H49Q, A76E, F91S, L104M, T107A, R113W | 79,333 | 1.68 | 1,026 | 0.07 | 2,313 | 0.14 |
| P18S, S52P, S65A, S67V, L79P, F91S, L104M, T107S, R113W | 23,766 | 0.50 | 1,004 | 0.07 | 1,080 | 0.06 |
| T15I, P18T, L79P, F91S, L104M, G111R | 55,498 | 1.17 | 1,516 | 0.10 | 1,030 | 0.06 |
| P18F, T26M, L44V, Q62K, L79P, E82D, F91S, L104M, G111D | 213,640 | 4.51 | 991 | 0.06 | 1,276 | 0.07 |
| P18T, E37G, G53R, Q62K, L79P, F91S, E98D, L104M, T107M | 251,288 | 5.31 | 2,001 | 0.13 | 45,878 | 2.69 |
| P18L, K70E, L79P, F91S, V95A, G111R | 62,608 | 1.32 | 1,117 | 0.07 | 973 | 0.06 |
| V9I, Q12K, P18F, S65A, S67V, L79P, L104T, G111R, S112I | 81,932 | 1.73 | 803 | 0.05 | 68,295 | 4.00 |
| P18F, S65A, S67V, F91S, L104M, G111R | 30,661 | 0.65 | 901 | 0.06 | 3,193 | 0.19 |
| V9I, V10I, P18S, F20S, T45A, L79P, F91S, L104M, F108Y, G111R, S112V | 151,489 | 3.20 | 973 | 0.06 | 974 | 0.06 |
| V9L, P18L, L79P, M90I, F91S, T102S, L104M, G111R | 155,279 | 3.28 | 910 | 0.06 | 10,568 | 0.62 |
| P18C, T26M, L44V, M55I, Q62K, L79P, F91S, L104M, T107M | 137,521 | 2.91 | 973 | 0.06 | 111,085 | 6.51 |
| V91, P18T, D23G, L79P, F91S, G111R | 151,426 | 3.20 | 897 | 0.06 | 2,725 | 0.16 |
| P18F, L79P, M90L, F91S, V95A, L104M, G111R | 125,639 | 2.66 | 917 | 0.06 | 3,939 | 0.23 |
| P18F, L79P, M90L, F91S, V95A, L104M, G111R | 115,156 | 2.43 | 1,073 | 0.07 | 2,464 | 0.14 |
| P18T, M36T, S65A, S67E, L79Q, A81T, F91S, G111R | 10,616 | 0.22 | 1,130 | 0.07 | 963 | 0.06 |
| V9L, P18T, Q62R, L79P, F91S, L104M, G111R | 195,111 | 4.12 | 835 | 0.05 | 1,497 | 0.09 |
| CD155-ECD-Fc | 47,319 | 1.00 | 15,421 | 1.00 | 17,067 | 1.00 |
| Fc Control | 2,298 | 0.05 | 1,133 | 0.07 | 996 | 0.06 |

TABLE E10F

Additional CD155 Variants and Binding Data.

| CD155 Mutations | TIGIT MFI at 25 nM | TIGIT Fold Change from CD155-ECD | CD226 MFI at 25 nM | CD226 Fold Change from CD155-ECD | CD112R MFI at 25 nM | CD112R Fold Change from CD155-ECD | CD96 MFI at 25 nM | CD96 Fold Change from CD155-ECD |
|---|---|---|---|---|---|---|---|---|
| P18T, G19D, M36T, S54N, L79P, L83Q, F91S, T107M, F108Y | 905 | 0.02 | 748 | 0.02 | 1276 | 1.56 | 726 | 0.01 |
| V9L, P18L, M55V, S69L, L79P, A81E, F91S, T107M | 58656 | 1.34 | 11166 | 0.29 | 920 | 1.13 | 67364 | 1.39 |

TABLE E10F-continued

Additional CD155 Variants and Binding Data.

| | TIGIT | | CD226 | | CD112R | | CD96 | |
|---|---|---|---|---|---|---|---|---|
| CD155 Mutations | MFI at 25 nM | Fold Change from CD155-ECD | MFI at 25 nM | Fold Change from CD155-ECD | MFI at 25 nM | Fold Change from CD155-ECD | MFI at 25 nM | Fold Change from CD155-ECD |
| P18F, H40Q, T61K, Q62K, L79P, F91S, L104M, T107V | 108441 | 2.48 | 853 | 0.02 | 918 | 1.13 | 8035 | 0.17 |
| P18S, Q32R, Q62K, R78G, L79P, F91S, T107A, R113W | 5772 | 0.13 | 701 | 0.02 | 843 | 1.03 | 831 | 0.02 |
| Q12H, P18T, L21S, G22S, V57A, Q62R, L79P, F91S, T107M | 1084 | 0.02 | 687 | 0.02 | 876 | 1.07 | 818 | 0.02 |
| V9I, P18S, S24P, H49Q, F58Y, Q60R, Q62K, L79P, F91S, T107M | 69926 | 1.60 | 1089 | 0.03 | 1026 | 1.26 | 43856 | 0.90 |
| P18T, W46C, H49R, S65A, S67V, A76T, L79P, S87T, L104M | 918 | 0.02 | 640 | 0.02 | 803 | 0.98 | 717 | 0.01 |
| P18S, S42T, E51G, L79P, F91S, G92W, T107M | 12630 | 0.29 | 707 | 0.02 | 857 | 1.05 | 1050 | 0.02 |
| P18S, S42T, E51G, L79P, F91S, G92W, T107M | 7476 | 0.17 | 851 | 0.02 | 935 | 1.15 | 924 | 0.02 |
| V10F, T15S, P18L, R48Q, L79P, F91S, T107M, V115M | 1168 | 0.03 | 792 | 0.02 | 901 | 1.10 | 998 | 0.02 |
| P18S, L21M, Y30F, N35D, R84W, F91S, T107M, D116G | 1377 | 0.03 | 743 | 0.02 | 946 | 1.16 | 1033 | 0.02 |
| P18F, E51V, S54G, Q60R, L79Q, E82G, S87T, M90I, F91S, G92R, T107M | 46090 | 1.05 | 15701 | 0.41 | 1012 | 1.24 | 61814 | 1.27 |
| Q16H, P18F, F91S, T107M | Little to no protein produced | | | | | | | |
| P18T, D23G, Q60R, S67L, L79P, F91S, T107M, V115A | 64091 | 1.47 | 30931 | 0.81 | 874 | 1.07 | 108875 | 2.24 |
| D8G, V9I, V11A, P18T, T26M, S52P, L79P, F91S, G92A, T107L, V115A | 52508 | 1.20 | 9483 | 0.25 | 817 | 1.00 | 97770 | 2.01 |
| V9I, P18F, A47E, G50S, E68G, L79P, F91S, T107M | 55167 | 1.26 | 54341 | 1.43 | 752 | 0.92 | 102115 | 2.10 |
| P18S, M55I, Q62K, S69P, L79P, F91S, T107M | Little to no protein produced | | | | | | | |
| P18T, T39S, S52P, S54R, L79P, F91S, T107M | 45927 | 1.05 | 744 | 0.02 | 1038 | 1.27 | 1225 | 0.03 |
| P18S, D23N, L79P, F91S, T107M, S114N | Little to no protein produced | | | | | | | |
| P18S, P34S, E51V, L79P, F91S, G111R | 7917 | 0.18 | 769 | 0.02 | 853 | 1.04 | 892 | 0.02 |
| P18S, H59N, V75A, L79P, A81T, F91S, L104M, T107M | 800 | 0.02 | 676 | 0.02 | 915 | 1.12 | 759 | 0.02 |
| P18S, W46R, E68D, L79P, F91S, T107M, R113G | 1359 | 0.03 | 717 | 0.02 | 798 | 0.98 | 737 | 0.02 |
| V9L, P18F, T45A, S65A, S67V, R78K, L79V, F91S, T107M, S114T | 130274 | 2.98 | 153569 | 4.04 | 812 | 1.00 | 85605 | 1.76 |
| P18T, M55L, T61R, L79P, F91S, V106I, T107M | 133399 | 3.05 | 1906 | 0.05 | 827 | 1.01 | 57927 | 1.19 |
| T15I, P18S, V33M, N35F, T39S, M55L, R78S, L79P, F91S, T107M | 7550 | 0.17 | 1015 | 0.03 | 789 | 0.97 | 2709 | 0.06 |
| P18S, Q62K, K70E, L79P, F91S, G92E, R113W | 11173 | 0.26 | 691 | 0.02 | 735 | 0.90 | 1951 | 0.04 |
| P18F, F20I, T26M, A47V, E51K, L79P, F91S | 136088 | 3.11 | 54026 | 1.42 | 1401 | 1.72 | 96629 | 1.99 |
| P18T, D23A, Q60H, L79P, M90V, F91S, T107M | 43795 | 1.00 | 98241 | 2.58 | 888 | 1.09 | 70891 | 1.46 |
| P18S, D23G, C29R, N35D, E37G, M55I, Q62K, S65A, S67G, R78G, L79P, F91S, L104M, T107M, Q110R | 1599 | 0.04 | 1030 | 0.03 | 1115 | 1.37 | 1944 | 0.04 |
| A13E, P18S, M36R, Q62K, S67T, L79P, N85D, F91S, T107M | Little to no protein produced | | | | | | | |
| V91, P18T, H49R, L79P, N85D, F91S, L104T, T107M | 46375 | 1.06 | 76851 | 2.02 | 794 | 0.97 | 80210 | 1.65 |
| V9A, P18F, T61S, Q62L, L79P, F91S, G111R | 26109 | 0.60 | 891 | 0.02 | 825 | 1.01 | 2633 | 0.05 |
| D8E, P18T, T61A, L79P, F91S, T107M | Little to no protein produced | | | | | | | |

TABLE E10F-continued

Additional CD155 Variants and Binding Data.

| CD155 Mutations | TIGIT MFI at 25 nM | TIGIT Fold Change from CD155-ECD | CD226 MFI at 25 nM | CD226 Fold Change from CD155-ECD | CD112R MFI at 25 nM | CD112R Fold Change from CD155-ECD | CD96 MFI at 25 nM | CD96 Fold Change from CD155-ECD |
|---|---|---|---|---|---|---|---|---|
| P18S, V41A, H49R, S54C, L79S, N85Y, L88P, F91S, L104M, T107M | 1098 | 0.03 | 830 | 0.02 | 876 | 1.07 | 1678 | 0.03 |
| V11E, P18H, F20Y, V25E, N35S, H49R, L79P, F91S, T107M, G111R | 979 | 0.02 | 846 | 0.02 | 844 | 1.03 | 928 | 0.02 |
| V11A, P18F, D23A, L79P, G80D, V95A, T107M | 45249 | 1.04 | 913 | 0.02 | 830 | 1.02 | 33883 | 0.70 |
| P18S, K70R, L79P, F91S, G111R | 16180 | 0.37 | 793 | 0.02 | 854 | 1.05 | 1182 | 0.02 |
| P18T, D23A, Q60H, L79P, M90V, F91S, T107M | 175673 | 4.02 | 161958 | 4.26 | 879 | 1.08 | 50981 | 1.05 |
| V9L, V11M, P18S, N35S, S54G, Q62K, L79P, L104M, T107M, V115M | 2999 | 0.07 | 2315 | 0.06 | 893 | 1.09 | 925 | 0.02 |
| V9L, P18Y, V25A, V38G, M55V, A77T, L79P, M90I, F91S, L104M | 138011 | 3.16 | 26015 | 0.68 | 919 | 1.13 | 17970 | 0.37 |
| V10G, P18T, L72Q, L79P, F91S, T107M | 4253 | 0.10 | 1584 | 0.04 | 863 | 1.06 | 3643 | 0.07 |
| P18S, H59R, A76G, R78S, L79P | 130622 | 2.99 | 79435 | 2.09 | 1009 | 1.24 | 44493 | 0.91 |
| V9A, P18S, M36T, S65G, L79P, F91S, L104T, G111R, S112I | 92503 | 2.12 | 989 | 0.03 | 886 | 1.09 | 7850 | 0.16 |
| P18T, S52A, V57A, Q60R, Q62K, S65C, L79P, F91T, N100Y, T107M | 187338 | 4.29 | 10579 | 0.28 | 908 | 1.11 | 3791 | 0.08 |
| V11A, P18F, N35D, A47E, Q62K, L79P, F91S, G99D, T107M, S114N | Little to no protein produced | | | | | | | |
| V11A, P18T, N35S, L79P, S87T, F91S | | | | | | | | |
| V9D, V11M, Q12L, P18S, E37V, M55I, Q60R, K70Q, L79P, F91S, L104M, T107M | 8693 | 0.20 | 790 | 0.02 | 852 | 1.04 | 1991 | 0.04 |
| T15S, P18S, Y30H, Q32L, Q62R, L79P, F91S, T107M | 16213 | 0.37 | 2092 | 0.06 | 1056 | 1.29 | 6994 | 0.14 |
| CD155-ECD-Fc | 43704 | 1.00 | 38032 | 1.00 | 816 | 1.00 | 48638 | 1.00 |
| CD112-IgV | 1289 | | 824 | | 17819 | | 1172 | 0.02 |

2. CD112 Binding and Bioactivity Data

Purified variant IgV Fc fusion proteins were tested to assess specificity and affinity of CD155 domain variant immunomodulatory proteins for cognate binding partners as described above using HEK293 cells expressing the full-length mammalian surface expression constructs for human TIGIT, CD112R, CD226 or CD96. For some molecules, soluble rCD112.Fc bioactivity was also tested in a human Mixed Lymphocyte Reaction (MLR).

TABLE E11A

Variant CD112 selected against cognate binding partners. Molecule sequences, binding data, and costimulatory bioactivity data.

| CD112 mutation(s) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|
| WT CD112 | 210829 (1.00) | 1452 (1.00) | 265392 (1.00) | 1112 (1.00) | 676.6 (1.00) |
| Y33H, A112V, G117D | 12948 (0.06) | 1552 (1.07) | 1368 (0.01) | 1241 (1.12) | 164.8 (0.24) |
| V19A, Y33H, S64G, S80G, G98S, N106Y, A112V | 48356 (0.23) | 1709 (1.18) | 2831 (0.01) | 1098 (0.99) | |
| L32P, A112V | 191432 (0.91) | 1557 (1.07) | 11095 (0.04) | 1259 (1.13) | 390.4 (0.58) |
| A95V, A112I | 238418 (1.13) | 1706 (1.17) | 51944 (0.20) | 1215 (1.09) | 282.5 (0.42) |

TABLE E11A-continued

Variant CD112 selected against cognate binding partners. Molecule sequences, binding data, and costimulatory bioactivity data.

| CD112 mutation(s) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|
| P28S,A112V | 251116 (1.19) | 1985 (1.37) | 153382 (0.58) | 1189 (1.07) | 503.4 (0.74) |
| P27A, T38N, V101A, A112V | 255803 (1.21) | 2138 (1.47) | 222822 (0.84) | 1399 (1.26) | 240.7 (0.36) |
| S118F | 11356 (0.05) | 5857 (4.03) | 6938 (0.03) | 1270 (1.14) | 271.7 (0.40) |
| R12W, H48Y, F54S, S118F | 10940 (0.05) | 3474 (2.39) | 5161 (0.02) | 1069 (0.96) | |
| R12W, Q79R, S118F | 2339 (0.01) | 7370 (5.08) | 1880 (0.01) | 1338 (1.20) | 447.4 (0.66) |
| T113S, S118Y | 6212 (0.03) | 6823 (4.70) | 1554 (0.01) | 1214 (1.09) | 225.1 (0.33) |
| S118Y | 2921 (0.01) | 6535 (4.50) | 2003 (0.01) | 1463 (1.32) | 190.4 (0.28) |
| N106I, S118Y | 2750 (0.01) | 7729 (5.32) | 1815 (0.01) | 1222 (1.10) | 265.8 (0.39) |
| N106I, S118F | 1841 (0.01) | 9944 (6.85) | 1529 (0.01) | 1308 (1.18) | 437.9 (0.65) |
| A95T, L96P, S118Y | 2352 (0.01) | 4493 (3.09) | 1412 (0.01) | 1329 (1.19) | 292.4 (0.43) |
| Y33H, P67S, N106Y, A112V | 225015 (1.07) | 3259 (2.24) | 204434 (0.77) | 1296 (1.17) | 618.8 (0.91) |
| N106Y, A112V | 6036 (0.03) | 1974 (1.36) | 15334 (0.06) | 1108 (1.00) | 409.9 (0.61) |
| T18S, Y33H, A112V | 252647 (1.20) | 1347 (0.93) | 183181 (0.69) | 1412 (1.27) | 601.8 (0.89) |
| P9S, Y33H, N47S, A112V | 240467 (1.14) | 1418 (0.98) | 203608 (0.77) | 1361 (1.22) | 449.1 (0.66) |
| P42S, P67H, A112V | 204484 (0.97) | 1610 (1.11) | 188647 (0.71) | 1174 (1.06) | 530.6 (0.78) |
| P27L, L32P, P42S, A112V | 219883 (1.04) | 1963 (1.35) | 84319 (0.32) | 1900 (1.71) | 251.6 (0.37) |
| G98D, A112V | 4879 (0.02) | 2369 (1.63) | 6100 (0.02) | 1729 (1.55) | 387.0 (0.57) |
| Y33H, S35P, N106Y, A112V | 250724 (1.19) | 1715 (1.18) | 94373 (0.36) | 1495 (1.34) | 516.2 (0.76) |
| L32P, P42S, T100A, A112V | 242675 (1.15) | 1742 (1.20) | 202567 (0.76) | 1748 (1.57) | 435.3 (0.64) |
| P27S, P45S, N106I, A112V | 223557 (1.06) | 1799 (1.24) | 84836 (0.32) | 1574 (1.42) | 277.5 (0.41) |
| Y33H, N47K, A112V | 251339 (1.19) | 1525 (1.05) | 199601 (0.75) | 1325 (1.19) | 483.2 (0.71) |
| Y33H, N106Y, A112V | 297169 (1.41) | 1782 (1.23) | 258315 (0.97) | 1440 (1.30) | 485.4 (0.72) |
| K78R, D84G, A112V, F114S | 236662 (1.12) | 1638 (1.13) | 24850 (0.09) | 1345 (1.21) | 142.5 (0.21) |
| Y33H, N47K, F54L, A112V | 14483 (0.07) | 1617 (1.11) | 2371 (0.01) | 1353 (1.22) | 352.8 (0.52) |
| Y33H, A112V | 98954 (0.47) | 1216 (0.84) | 1726 (0.01) | 1298 (1.17) | |
| A95V, A112V | 168521 (0.80) | 2021 (1.39) | 200789 (0.76) | 1459 (1.31) | 412.9 (0.61) |
| R12W, A112V | 135635 (0.64) | 1582 (1.09) | 23378 (0.09) | 1412 (1.27) | 165.8 (0.24) |
| A112V | 213576 (1.01) | 1986 (1.37) | 151900 (0.57) | 1409 (1.27) | 211.4 (0.31) |
| Y33H, A112V | 250667 (1.19) | 1628 (1.12) | 230578 (0.87) | 1216 (1.09) | 612.7 (0.91) |
| R12W, P27S, A112V | 3653 (0.02) | 1308 (0.90) | 9105 (0.03) | 1051 (0.94) | |
| Y33H, V51M, A112V | 218698 (1.04) | 1384 (0.95) | 195450 (0.74) | 1170 (1.05) | 709.4 (1.05) |
| Y33H, A112V, S118T | 219384 (1.04) | 1566 (1.08) | 192645 (0.73) | 1313 (1.18) | 396.3 (0.59) |
| Y33H, V101A, A112V, P115S | 5605 (0.03) | 1582 (1.09) | 5079 (0.02) | 1197 (1.08) | |
| H24R, T38N, D43G, A112V | 227095 (1.08) | 1537 (1.06) | 229311 (0.86) | 1336 (1.20) | 858.6 (1.27) |
| A112V | 4056 (0.02) | 1356 (0.93) | 10365 (0.04) | 986 (0.89) | |

TABLE E11A-continued

Variant CD112 selected against cognate binding partners. Molecule sequences, binding data, and costimulatory bioactivity data.

| CD112 mutation(s) | TIGIT tfxn MFI (TIGIT MFI parental ratio) | CD112R tfxn MFI (CD112R MFI parental ratio) | CD226 MFI (CD226 MFI parental ratio) | Mock Expi293 MFI (Mock MFI parental ratio) | Anti-CD3 IFN-gamma (pg/mL) (Anti-CD3 IFN-gamma parental ratio) |
|---|---|---|---|---|---|
| P27A, A112V | 193537 (0.92) | 1531 (1.05) | 230708 (0.87) | 3084 (2.77) | 355.1 (0.52) |
| A112V, S118T | 233173 (1.11) | 1659 (1.14) | 121817 (0.46) | 845 (0.76) | 533.3 (0.79) |
| R12W, A112V, M122I | 235935 (1.12) | 1463 (1.01) | 217748 (0.82) | 1350 (1.21) | 528.0 (0.78) |
| Q83K, N106Y, A112V | 205948 (0.98) | 2042 (1.41) | 234958 (0.89) | 1551 (1.39) | 481.4 (0.71) |
| R12W, P27S, A112V, S118T | 11985 (0.06) | 2667 (1.84) | 12756 (0.05) | 1257 (1.13) | 334.4 (0.49) |
| P28S, Y33H, A112V | 4711 (0.02) | 1412 (0.97) | 3968 (0.01) | 955 (0.86) | |
| P27S, Q90R, A112V | 3295 (0.02) | 1338 (0.92) | 6755 (0.03) | 1048 (0.94) | |
| L15V, P27A, A112V, S118T | 209888 (1.00) | 1489 (1.03) | 84224 (0.32) | 1251 (1.13) | 512.3 0.76) |
| Y33H, N106Y, T108I, A112V | | | Not tested | | |
| Y33H, P56L, V75M, V101M, A112V | | | Not tested | | |

TABLE E11B

Additional CD112 Variants and Binding Data.

| CD112 Mutation(s) | TIGIT | | CD226 | | CD112R | | CD96 | |
|---|---|---|---|---|---|---|---|---|
| | MFI 100 nM | Fold Increase to WT IgV | MFI at 100 nM | Fold Increase to WT IgV | MFI at 100 nM | Fold Increase to WT IgV | MFI at 100 nM | Fold Increase to WT IgV |
| S118F | 1763 | 0.02 | 1645 | 0.08 | 2974 | 0.61 | 1659 | 0.19 |
| N47K, Q79R, S118F | 1738 | 0.02 | 1689 | 0.09 | 2637 | 0.54 | 1647 | 0.19 |
| Q40R, P60T, A112V, S118T | 4980 | 0.06 | 1608 | 0.08 | 2399 | 0.50 | 2724 | 0.32 |
| F114Y, S118F | 110506 | 1.34 | 7325 | 0.37 | 1502 | 0.31 | 1553 | 0.18 |
| N106I, S118Y | 1981 | 0.02 | 1700 | 0.09 | 2394 | 0.49 | 1582 | 0.19 |
| S118Y | 101296 | 1.23 | 9990 | 0.50 | 1429 | 0.30 | 1551 | 0.18 |
| Y33H, K78R, S118Y | 2276 | 0.03 | 2115 | 0.11 | 3429 | 0.71 | 2082 | 0.24 |
| N106I, S118F | 1875 | 0.02 | 1675 | 0.08 | 2365 | 0.49 | 1662 | 0.19 |
| R12W, A46T, K66M, Q79R, N106I, T113A, S118F | 3357 | 0.04 | 1808 | 0.09 | 1664 | 0.34 | 4057 | 0.48 |
| Y33H, A112V, S118F | 3376 | 0.04 | 2886 | 0.15 | 3574 | 0.74 | 3685 | 0.43 |
| R12W, Y33H, N106I, S118F | 100624 | 1.22 | 24513 | 1.24 | 1490 | 0.31 | 2060 | 0.24 |
| L15V, Q90R, S118F | 5791 | 0.07 | 4169 | 0.21 | 2752 | 0.57 | 4458 | 0.52 |
| N47K, D84G, N106I, S118Y | 3334 | 0.04 | 2819 | 0.14 | 2528 | 0.52 | 3498 | 0.41 |
| L32P, S118F | 3881 | 0.05 | 2506 | 0.13 | 2659 | 0.55 | 2518 | 0.29 |
| Y33H, Q79R, A112V, S118Y | | | | Low to no protein produced | | | | |
| T18A, N106I, S118T | 84035 | 1.02 | 10208 | 0.52 | 1585 | 0.33 | 1590 | 0.19 |
| L15V, Y33H, N106Y, A112V, S118F | | | | Low to no protein produced | | | | |
| V37M, S118F | 96986 | 1.18 | 2523 | 0.13 | 1985 | 0.41 | 1849 | 0.22 |
| N47K, A112V, S118Y | 1980 | 0.02 | 1859 | 0.09 | 2733 | 0.56 | 1825 | 0.21 |
| A46T, A112V | 4224 | 0.05 | 4685 | 0.24 | 3288 | 0.68 | 4273 | 0.50 |
| P28S, Y33H, N106I, S118Y | 6094 | 0.07 | 2181 | 0.11 | 1891 | 0.39 | 3021 | 0.35 |

TABLE E11B-continued

Additional CD112 Variants and Binding Data.

| | TIGIT | | CD226 | | CD112R | | CD96 | |
|---|---|---|---|---|---|---|---|---|
| CD112 Mutation(s) | MFI 100 nM | Fold Increase to WT IgV | MFI at 100 nM | Fold Increase to WT IgV | MFI at 100 nM | Fold Increase to WT IgV | MFI at 100 nM | Fold Increase to WT IgV |
| P30S, Y33H, N47K, V75M, Q79R, N106I, S118Y | 2247 | 0.03 | 2044 | 0.10 | 1796 | 0.37 | 2658 | 0.31 |
| V19A, N47K, N106Y, K116E, S118Y | 2504 | 0.03 | 2395 | 0.12 | 2174 | 0.45 | 2852 | 0.33 |
| Q79R, T85A, A112V, S118Y | 2192 | 0.03 | 1741 | 0.09 | 2367 | 0.49 | 1620 | 0.19 |
| Y33H, A112V | 20646 | 0.25 | 1465 | 0.07 | 1794 | 0.37 | 2589 | 0.30 |
| V101M, N106I, S118Y | 55274 | 0.67 | 6625 | 0.33 | 1357 | 0.28 | 1494 | 0.17 |
| Y33H, Q79R, N106I, A112V, S118T | 6095 | 0.07 | 1760 | 0.09 | 2393 | 0.49 | 3033 | 0.36 |
| Q79R, A112V | 1571 | 0.02 | 1490 | 0.08 | 2284 | 0.47 | 1326 | 0.16 |
| Y33H, A46T, Q79R, N106I, S118F | 90813 | 1.10 | 15626 | 0.79 | 1298 | 0.27 | 3571 | 0.42 |
| A112V, G121S | 95674 | 1.16 | 19992 | 1.01 | 1252 | 0.26 | 4005 | 0.47 |
| Y33H, Q79R, N106I, S118Y | 36246 | 0.44 | 2118 | 0.11 | 1970 | 0.41 | 3250 | 0.38 |
| Y33H, N106I, A112V | 47352 | 0.57 | 4217 | 0.21 | 2641 | 0.55 | 1488 | 0.17 |
| Y33H, A46T, V101M, A112V, S118T | 14413 | 0.17 | 1596 | 0.08 | 2335 | 0.48 | 1441 | 0.17 |
| L32P, L99M, N106I, S118F | 3056 | 0.04 | 1791 | 0.09 | 2210 | 0.46 | 2000 | 0.23 |
| L32P, T108A, S118F | 104685 | 1.27 | 4531 | 0.23 | 2308 | 0.48 | 1518 | 0.18 |
| A112V | 4937 | 0.06 | 1903 | 0.10 | 1646 | 0.34 | 3011 | 0.35 |
| R12W, Q79R, A112V | 55539 | 0.67 | 6918 | 0.35 | 1386 | 0.29 | 1740 | 0.20 |
| Y33H, N106Y, E110G, A112V | 2786 | 0.03 | 2517 | 0.13 | 1787 | 0.37 | 2023 | 0.24 |
| Y33H, N106I, S118Y | 1967 | 0.02 | 1579 | 0.08 | 2601 | 0.54 | 1517 | 0.18 |
| Q79R, S118F | 82055 | 1.00 | 7582 | 0.38 | 1298 | 0.27 | 1970 | 0.23 |
| Y33H, Q79R, G98D, V101M, A112V | 21940 | 0.27 | 1632 | 0.08 | 1141 | 0.24 | 18423 | 2.16 |
| N47K, T81S, V101M, A112V, S118F | 6889 | 0.08 | 1311 | 0.07 | 1303 | 0.27 | 1145 | 0.13 |
| G82S, S118Y | 4267 | 0.05 | 1938 | 0.10 | 2140 | 0.44 | 2812 | 0.33 |
| Y33H, A112V, S118Y | 14450 | 0.18 | 1532 | 0.08 | 2353 | 0.49 | 3004 | 0.35 |
| Y33H, N47K, Q79R, N106Y, A112V | 70440 | 0.85 | 3557 | 0.18 | 1447 | 0.30 | 1679 | 0.20 |
| Y33H, S118T | 113896 | 1.38 | 17724 | 0.89 | 1252 | 0.26 | 5001 | 0.59 |
| R12W, Y33H, Q79R, V101M, A112V | 3376 | 0.04 | 2727 | 0.14 | 2047 | 0.42 | 2339 | 0.27 |
| S118F | 2685 | 0.03 | 1864 | 0.09 | 2520 | 0.52 | 1566 | 0.18 |
| Wildtype CD112-IgV Fc | 82414 | 1.00 | 19803 | 1.00 | 4842 | 1.00 | 8541 | 1.00 |
| CD112 ECD-Fc | 29157 | 0.35 | 8755 | 0.44 | 1107 | 0.23 | 1103 | 0.13 |
| Anti-hFc PE | 1383 | 0.02 | 1461 | 0.07 | 1358 | 0.28 | 1468 | 0.17 |

TABLE E11C

Additional CD112 Variants and Binding Data.

| CD112 Mutation(s) | TIGIT MFI 20 nM | TIGIT Fold Increase to WT IgV | CD226 MFI at 20 nM | CD226 Fold Increase to WT IgV | CD112R MFI at 20 nM | CD112R Fold Increase to WT IgV | CD96 MFI at 20 nM | CD96 Fold Increase to WT IgV |
|---|---|---|---|---|---|---|---|---|
| N106I, S118Y | 1288 | 0.04 | 1334 | 0.12 | 6920 | 4.16 | 1102 | 0.44 |
| Y33H, Q83K, A112V, S118T | 115690 | 3.31 | 10046 | 0.93 | 1128 | 0.68 | 2053 | 0.82 |
| R12W, Q79R, S118F | 1436 | 0.04 | 1296 | 0.12 | 6546 | 3.93 | 1046 | 0.42 |
| V29M, Y33H, N106I, S118F | Not tested | | | | | | | |
| Y33H, A46T, A112V | 111256 | 3.18 | 14974 | 1.39 | 1148 | 0.69 | 3333 | 1.34 |
| Y33H, Q79R, S118F | 1483 | 0.04 | 1326 | 0.12 | 7425 | 4.46 | 1138 | 0.46 |
| Y33H, N47K, F74L, S118F | 1338 | 0.04 | 1159 | 0.11 | 1516 | 0.91 | 1140 | 0.46 |
| R12W, V101M, N106I, S118Y | 1378 | 0.04 | 1249 | 0.12 | 5980 | 3.59 | 1182 | 0.47 |
| A46T, V101A, N106I, S118Y | 1359 | 0.04 | 1199 | 0.11 | 6729 | 4.04 | 1173 | 0.47 |
| Y33H, N106Y, A112V | 113580 | 3.25 | 17771 | 1.65 | 1207 | 0.72 | 2476 | 0.99 |
| N106Y, A112V, S118T | Not tested | | | | | | | |
| S76P, T81I, V101M, N106Y, A112V, S118F | Not tested | | | | | | | |
| N106Y, A112V | 29015 | 0.83 | 2760 | 0.26 | 1159 | 0.70 | 1639 | 0.66 |
| P9R, L21V, P22L, I34M, S69F, F74L, A87V, A112V, L125A | 1920 | 0.05 | 1218 | 0.11 | 1107 | 0.66 | 1074 | 0.43 |
| Y33H, V101M, A112V | 126266 | 3.61 | 24408 | 2.27 | 1150 | 0.69 | 4535 | 1.82 |
| N106I, S118F | 1776 | 0.05 | 1385 | 0.13 | 9058 | 5.44 | 1370 | 0.55 |
| V29A, L32P, S118F | 1265 | 0.04 | 1148 | 0.11 | 5057 | 3.04 | 1194 | 0.48 |
| A112V | 69673 | 1.99 | 6387 | 0.59 | 1140 | 0.68 | 1214 | 0.49 |
| Y33H, V101M, A112V | 133815 | 3.83 | 24992 | 2.32 | 1184 | 0.71 | 6338 | 2.54 |
| P28S, Y33H, N106I, S118Y | 2745 | 0.08 | 1689 | 0.16 | 6625 | 3.98 | 1978 | 0.79 |
| Y33H, V101M, N106I, A112V | 118654 | 3.40 | 21828 | 2.03 | 1253 | 0.75 | 3871 | 1.55 |
| R12W, Y33H, N47K, Q79R, S118Y | 171390 | 4.91 | 5077 | 0.47 | 1124 | 0.68 | 2636 | 1.06 |
| A112V, S118T | 103203 | 2.95 | 15076 | 1.40 | 1155 | 0.69 | 1426 | 0.57 |
| Y33H, A46T, A112V, S118T | 141859 | 4.06 | 29436 | 2.74 | 1184 | 0.71 | 5760 | 2.31 |
| Y33H, A112V, F114L, S118T | 5161 | 0.15 | 1734 | 0.16 | 1184 | 0.71 | 1249 | 0.50 |
| A112V | 78902 | 2.26 | 6224 | 0.58 | 1114 | 0.67 | 1181 | 0.47 |
| Y33H, T38A, A46T, V101M, A112V | 111293 | 3.19 | 25702 | 2.39 | 1192 | 0.72 | 99015 | 39.69 |
| Q79R, A112V | 96674 | 2.77 | 7264 | 0.67 | 1130 | 0.68 | 1216 | 0.49 |
| Y33H, N106I, S118Y | 5720 | 0.16 | 1453 | 0.14 | 6543 | 3.93 | 1248 | 0.50 |
| P28S, Y33H, S69P, N106I, A112V, S118Y | 22393 | 0.64 | 1378 | 0.13 | 1550 | 0.93 | 19174 | 7.68 |
| Y33H, P42L, N47K, V101M, A112V | 214116 | 6.13 | 13878 | 1.29 | 1315 | 0.79 | 4753 | 1.91 |
| Y33H, N47K, F74S, Q83K, N106I, F111L, A112V, S118T | 6719 | 0.19 | 1319 | 0.12 | 1305 | 0.78 | 1278 | 0.51 |
| Y33H, A112V, S118T, V119A | 184794 | 5.29 | 10204 | 0.95 | 1269 | 0.76 | 4321 | 1.73 |
| Y33H, N106I, A112V, S118F | 6872 | 0.20 | 1591 | 0.15 | 2308 | 1.39 | 2796 | 1.12 |
| Y33H, K66M, S118F, W124L | 1724 | 0.05 | 1259 | 0.12 | 6782 | 4.07 | 1197 | 0.48 |
| S118F | 1325 | 0.04 | 1213 | 0.11 | 7029 | 4.22 | 1135 | 0.46 |
| N106I, A112V | 111342 | 3.19 | 4241 | 0.39 | 1546 | 0.93 | 1178 | 0.47 |
| Y33H, A112V | 177926 | 5.09 | 13761 | 1.28 | 1152 | 0.69 | 3117 | 1.25 |
| WT CD112 IgV | 34932 | 1.00 | 10762 | 1.00 | 1665 | 1.00 | 2495 | 1.00 |
| WT CD112-Fc ECD | 28277 | 0.81 | 8023 | 0.75 | 1253 | 0.75 | 1064 | 0.43 |
| Anti-huFc PE | 1138 | 0.03 | 1006 | 0.09 | 1010 | 0.61 | 1062 | 0.43 |

3. PD-L1 Binding and Bioactivity Data

For PD-L1, binding studies were carried out using Jurkat/IL-2 reporter cells (purchased from Promega Corp. USA) that were then transduced to stably express human PD-1 (Jurkat/PD-1 cells). For staining by flow cytometry, 100,000 Jurkat/PD-1 cells or negative control (Jurkat only) were plated in 96 well round bottom plates. Cells were spun down and resuspended in staining buffer (PBS (phosphate buffered saline), 1% BSA (bovine serum albumin), and 0.1% sodium azide) for 20 minutes to block non-specific binding. Afterwards, cells were centrifuged again and resuspended in 50 μl staining buffer containing 100 nM to 46 pM of each candidate PD-L1 variant Fc fusion protein. As controls, a full extracellular domain of wild-type PD-L1 (composed of one IgV and one IgC domain) fused to Fc ("Full length ECD of PD-L1") and a IgV domain of wild-type PD-L1 ("wild type PD-L1 IgV") were tested. Primary staining was performed on ice for 45 minutes, before washing cells twice in 150 ul staining buffer. PE-conjugated anti-human Fc (Jackson ImmunoResearch, USA) was diluted 1:150 in 50 μl staining buffer and added to cells and incubated another 30 minutes on ice. Secondary antibody was washed out twice, cells were fixed in 4% formaldehyde/PBS, and samples were analyzed on Intellicyt flow cytometer (Intellicyt Corp, USA).

TABLE E12A

Selected PD-L1 variants and binding data.

| PD-L1 Mutation(s) | Binding to Jurkat/PD-1 Cells: MFI at 50 nM | Binding to Jurkat/PD-1 Cells: Fold increase over wildtype PD-L1 IgV-Fc |
|---|---|---|
| K28N, M41V, N45T, H51N, K57E | 12585 | 2.4 |
| I20L, I36T, N45D, I47T | 3119 | 0.6 |
| I20L, M41K, K44E | 9206 | 1.8 |
| P6S, N45T, N78I, I83T | 419 | 0.1 |
| N78I | 2249 | 0.4 |
| M41K, N78I | Little or no protein produced | |
| N17D, N45T, V50A, D72G | Little or no protein produced | |
| I20L, F49S | Little or no protein produced | |
| N45T, V50A | 23887 | 4.6 |
| I20L, N45T, N78I | 29104 | 5.6 |
| N45T, N78I | 24865 | 4.7 |
| I20L, N45T | 24279 | 4.6 |
| I20L, N45T, V50A | 34158 | 6.5 |
| N45T | 6687 | 1.3 |
| M41K | 5079 | 1.0 |
| M41V, N45T | Little or no protein produced | |
| M41K, N45T | Little or no protein produced | |
| A33D, S75P, D85E | 685 | 0.1 |
| M18I, M41K, D43G, H51R, N78I | 20731 | 4.0 |
| V11E, I20L, I36T, N45D, H60R, S75P | 3313 | 0.6 |
| A33D, V50A | Little or no protein produced | |
| S16G, A33D, K71E, S75P | Little or no protein produced | |
| E27G, N45T, M97I | 881 | 0.2 |
| E27G, N45T, K57R | 5022 | 1.0 |
| A33D, E53V | 650 | 0.1 |
| D43G, N45D, V58A | 63960 | 12.2 |
| E40G, D43V, N45T, V50A | 809 | 0.2 |
| Y14S, K28E, N45T | 16232 | 3.1 |
| A33D, N78S | 1725 | 0.3 |
| A33D, N78I | 8482 | 1.6 |
| A33D, N45T | 17220 | 3.3 |
| A33D, N45T, N78I | Little or no protein produced | |
| E27G, N45T, V50A | 25267 | 4.8 |
| N45T, V50A, N78S | 28572 | 5.4 |
| N45T, V50A | 18717 | 3.6 |
| I20L, N45T, V110M | 464 | 0.1 |
| I20L, I36T, N45T, V50A | 7658 | 1.5 |
| N45T, L74P, S75P | 5251 | 1.0 |
| N45T, S75P | 12200 | 2.3 |
| S75P, K106R | 388 | 0.1 |
| S75P | 1230 | 0.2 |
| A33D, S75P | 306 | 0.1 |
| A33D, S75P, D104G | 251 | 0.0 |
| A33D, S75P | 1786 | 0.3 |
| I20L, E27G, N45T, V50A | 29843 | 5.7 |
| I20L, E27G, D43G, N45D, V58A, N78I | 69486 | 13.3 |
| I20L, D43G, N45D, V58A, N78I | 72738 | 13.9 |
| I20L, A33D, D43G, N45D, V58A, N78I | 80205 | 15.3 |
| I20L, D43G, N45D, N78I | 67018 | 12.8 |
| E27G, N45T, V50A, N78I | 30677 | 5.9 |
| N45T, V50A, N78I | 32165 | 6.1 |
| V11A, I20L, E27G, D43G, N45D, H51Y, S99G | 73727 | 14.1 |
| I20L, E27G, D43G, N45T, V50A | 36739 | 7.0 |
| I20L, K28E, D43G, N45D, V58A, Q89R, | 80549 | 15.4 |
| I20L, I36T, N45D | 16870 | 3.2 |
| I20L, K28E, D43G, N45D, E53G, V58A, N78I | 139 | 0.0 |
| A33D, D43G, N45D, V58A, S75P | 58484 | 11.2 |

TABLE E12A-continued

Selected PD-L1 variants and binding data.

| PD-L1 Mutation(s) | Binding to Jurkat/PD-1 Cells MFI at 50 nM | Fold increase over wildtype PD-L1 IgV-Fc |
|---|---|---|
| K23R, D43G, N45D | 67559 | 12.9 |
| I20L, D43G, N45D, V58A, N78I, D90G, G101D | 259 | 0.0 |
| D43G, N45D, L56Q, V58A, G101G-ins | 88277 | 16.8 |
| I20L, K23E, D43G, N45D, V58A, N78I | 89608 | 17.1 |
| I20L, K23E, D43G, N45D, V50A, N78I | 88829 | 16.9 |
| T19I, E27G, N45I, V50A, N78I, M97K | 25496 | 4.9 |
| I20L, M41K, D43G, N45D | 599 | 0.1 |
| K23R, N45T, N78I | 84980 | 16.2 |
| Full length PD-L1 Fc | 18465 | 3.5 |
| Wild type PD-L1 IgV | 5243 | 1.0 |
| Anti-PD-1 monoclonal antibody (nivolumab) | 79787 | 15.2 |
| Human IgG | 198 | 0.0 |

TABLE E12B

Flow Binding to Cells Expressing PD-1 or CD80

| PD-L1 Mutation(s) | PD-1 MFI at 20 nM | PD-1 Fold Change Compared to WT PD-L1 | CD80 MFI at 20 nM | CD80 Fold Change Compared to WT PD-L1 |
|---|---|---|---|---|
| K57R, S99G | 2953 | 0.9 | 16253 | 121.3 |
| K57R, S99G, F189L | 1930 | 0.6 | 12906 | 96.3 |
| M18V, M97L, F193S, R195G, E200K, H202Q | 69 | 0.0 | 241 | 1.8 |
| I36S, M41K, M97L, K144Q, R195G, E200K, H202Q, L206F | 3498 | 1.1 | 68715 | 512.8 |
| C22R, Q65L, L124S, K144Q, R195G, E200N, H202Q, T221L | Little or no protein produced | | | |
| M18V, I98L, L124S, P198T, L206F | 2187 | 0.7 | 143 | 1.1 |
| S99G, N117S, 1148V, K171R, R180S | Little or no protein produced | | | |
| I36T, M97L, A103V, Q155H | 120 | 0.0 | 128 | 1.0 |
| K28I, S99G | 830 | 0.3 | 693 | 5.2 |
| R195S | 3191 | 1.0 | 138 | 1.0 |
| A79T, S99G, T185A, R195G, E200K, H202Q, L206F | 1963 | 0.6 | 643 | 4.8 |
| K57R, S99G, L124S, K144Q | 2081 | 0.7 | 14106 | 105.3 |
| K57R, S99G, R195G | 2479 | 0.8 | 10955 | 81.8 |
| D55V, M97L, S99G | 11907 | 3.8 | 71242 | 531.7 |
| E27G, I36T, D55N, M97L, K111E | 1904 | 0.6 | 88724 | 662.1 |
| E54G, M97L, S99G | 8414 | 2.7 | 51905 | 387.4 |
| G15A, I36T, M97L, K111E, H202Q | 112 | 0.0 | 13530 | 101.0 |
| G15A, I36T, V129D | 114 | 0.0 | 136 | 1.0 |
| G15A, I36T, V129D, R195G | 125 | 0.0 | 134 | 1.0 |
| G15A, V129D | 2075 | 0.7 | 128 | 1.0 |
| I36S, M97L | 3459 | 1.1 | 44551 | 332.5 |
| I36T, D55N, M97L, K111E, A204T | 265 | 0.1 | 62697 | 467.9 |
| I36T, D55N, M97L, K111E, V129A, F173L | 393 | 0.1 | 72641 | 542.1 |
| I36T, D55S, M97L, KI HE, 1148V, R180S | 94 | 0.0 | 30704 | 229.1 |
| I36T, G52R, M97L, V112A, K144E, V175A, P198T | 81 | 0.0 | 149 | 1.1 |
| I36T, 146V, D55G, M97L, K106E, K144E, T185A, R195G | 69 | 0.0 | 190 | 1.4 |
| I36T, I83T, M97L, K144E, P198T | 62 | 0.0 | 6216 | 46.4 |
| I36T, M97L, K111E | Little or no protein produced | | | |
| I36T, M97L, K144E, P198T | 197 | 0.1 | 40989 | 305.9 |
| I36T, M97L, Q155H, F193S, N201Y | 69 | 0.0 | 1251 | 9.3 |
| I36T, M97L, V129D | 523 | 0.2 | 50905 | 379.9 |
| L35P, I36S, M97L, K111E | 190 | 0.1 | 155 | 1.2 |
| M18I, I36T, E53G, M97L, K144E, E199G, V207A | 104 | 0.0 | 47358 | 353.4 |
| M18T, I36T, D55N, M97L, K111E | 138 | 0.0 | 71440 | 533.1 |
| M18V, M97L, T176N, R195G | 1301 | 0.4 | 45300 | 338.1 |
| M97L, S99G | 12906 | 4.1 | 81630 | 609.2 |
| N17D, M97L, S99G | 10079 | 3.2 | 73249 | 546.6 |
| S99G, T185A, R195G, P198T | 2606 | 0.8 | 22062 | 164.6 |

TABLE E12B-continued

| Flow Binding to Cells Expressing PD-1 or CD80 | | | | |
|---|---|---|---|---|
| | PD-1 | | CD80 | |
| PD-L1 Mutation(s) | MFI at 20 nM | Fold Change Compared to WT PD-L1 | MFI at 20 nM | Fold Change Compared to WT PD-L1 |
| V129D, H202Q | 2001 | 0.6 | 219 | 1.6 |
| V129D, P198T | 3245 | 1.0 | 152 | 1.1 |
| V129D, T150A | 1941 | 0.6 | 142 | 1.1 |
| V93E, V129D | 1221 | 0.4 | 150 | 1.1 |
| Y10F, M18V, S99G, Q138R, T203A | 70 | 0.0 | 412 | 3.1 |
| WT PD-L1 (IgV + IgC) Fc | 3121 | 1.0 | 134 | 1.0 |
| CTLA4-Fc | 59 | N/A | 199670 | N/A |
| Anti-PDl mAb | 31482 | N/A | 134 | N/A |
| Fc Control | 59 | N/A | 132 | N/A |

TABLE E12C

| Additional Affinity-Matured IgSF Domain-Containing Molecules | |
|---|---|
| PD-L1 Mutation(s) | PD-L1 Mutation(s) |
| N45D | N45D, G102D, R194W, R195G |
| K160M, R195G | N45D, G52V, Q121L, P198S |
| N45D, K144E | N45D, I148V, R195G, N201D |
| N45D, P198S | N45D, K111T, T183A, I188V |
| N45D, P198T | N45D, Q89R, F189S, P198S |
| N45D, R195G | N45D, S99G, C137R, V207A |
| N45D, R195S | N45D, T163I, K167R, R195G |
| N45D, S131F | N45D, T183A, T192S, R194G |
| N45D, V58D | N45D, V50A, I119T, K144E |
| V129D, R195S | TWA, N45D, K144E, R195G |
| I98T, F173Y, L196S | V11E, N45D, T130A, P198T |
| N45D, E134G, L213P | V26A, N45D, T163I, T185A |
| N45D, F173I, S177C | K23N, N45D, L124S, K167T, R195G |
| N45D, I148V, R195G | K23N, N45D, Q73R, T163I |
| N45D, K111T, R195G | K28E, N45D, W149R, S158G, P198T |
| N45D, N113Y, R195S | K28R, N45D, K57E, I98V, R195S |
| N45D, N165Y, E170G | K28R, N45D, V129D, T163N, R195T |
| N45D, Q89R, 198V | M41K, D43G, N45D, R64S, R195G |
| N45D, S131F, P198S | M41K, D43G, N45D, R64S, S99G |
| N45D, S75P, P198S | N45D, R68L, F173L, D197G, P198S |
| N45D, V50A, R195T | N45D, V50A, I148V, R195G, N201D |
| E27D, N45D, T183A, I188V | M41K, D43G, K44E, N45D, R195G, N201D |
| F173Y, T183I, L196S, | N45D, V50A, L124S, K144E, L179P, |

TABLE E12C-continued

| Additional Affinity-Matured IgSF Domain-Containing Molecules | |
|---|---|
| PD-L1 Mutation(s) | PD-L1 Mutation(s) |
| T203A K23N, N45D, S75P, N120S | R195G |

4. PD-L2 Binding and Bioactivity Data

Binding studies were carried out using Jurkat/IL-2 reporter cells (purchased from Promega Corp. USA) that were then transduced to stably express PD-1 (Jurkat/PD-1) generally as described above for studies with PD-L1. In addition, protein-protein interactions between PD-1 and PD-L2 domain variant immunomodulatory proteins were further assessed using Fortebio binding assays. PD-1 was loaded individually onto anti-human capture sensors (ForteBio Octet AHC) and Fc fusions of full length wildtype (unmodified) PD-L2 IgV, full length ECD of PD-L2, full length ECD of PD-L1, or variant PD-L2 Fc-fusion molecules were bound to the PD-1 receptor at a single concentration of 100 nM. As a positive control, anti-PD-1 monoclonal antibody (nivolumab) was also assessed. Loading response of anti-human capture sensors of each binding protein being tested with the variant IgV-Fc fusion molecule was determined.

TABLE E13A

| Variant PD-L2 selected against PD-1. Molecule sequence and binding data. | | | |
|---|---|---|---|
| | Binding to Jurkat/PD-1 Cells | | Fortebio PD-1-Fc |
| PD-L2 mutation(s) | MFI at 50 nM | Fold increase over wildtype PD-L2 IgV-Fc | Response Units binding to |
| H15Q | 15998 | 1.63 | 0.007 |
| N24D | 1414 | 0.14 | −0.039 |
| E44D | 2928 | 0.3 | −0.006 |
| V89D | 3361 | 0.34 | 0.005 |
| Q82R, V89D | 44977 | 4.57 | 1.111 |
| E59G, Q82R | 12667 | 1.29 | −0.028 |
| S39I, V89D | 26130 | 2.65 | 0.26 |
| S67L, V89D | 15991 | 1.62 | 0.608 |
| S67L, I85F | 529 | 0.05 | −0.005 |
| S67L, I86T | 6833 | 0.69 | 0.141 |
| H15Q, K65R | 13497 | 1.37 | −0.001 |
| H15Q, Q72H, V89D | 12629 | 1.28 | 0.718 |
| H15Q, S67L, R76G | 47201 | 4.8 | 0.418 |
| H15Q, R76G, I85F | 2941 | 0.3 | −0.038 |

TABLE E13A-continued

Variant PD-L2 selected against PD-1. Molecule sequence and binding data.

| PD-L2 mutation(s) | Binding to Jurkat/PD-1 Cells MFI at 50 nM | Binding to Jurkat/PD-1 Cells Fold increase over wildtype PD-L2 IgV-Fc | Fortebio PD-1-Fc Response Units binding to |
|---|---|---|---|
| H15Q, T47A, Q82R | 65174 | 6.62 | 0.194 |
| H15Q, Q82R, V89D | 49652 | 5.04 | 1.198 |
| H15Q, C23S, I86T | 830 | 0.08 | −0.026 |
| H15Q, S39I, I86T | 1027 | 0.1 | 0.309 |
| H15Q, R76G, I85F | 1894 | 0.19 | −0.006 |
| E44D, V89D, W91R | 614 | 0.06 | −0.048 |
| I13V, S67L, V89D | 26200 | 2.66 | 1.42 |
| H15Q, S67L, I86T | 15952 | 1.62 | 0.988 |
| I13V, H15Q, S67L, I86T | 21570 | 2.19 | 1.391 |
| I13V, H15Q, E44D, V89D | 23958 | 2.43 | 1.399 |
| I13V, S39I, E44D, Q82R, V89D | 71423 | 7.26 | 0.697 |
| I13V, E44D, Q82R, V89D | 45191 | 4.59 | 1.283 |
| I13V, Q72H, R76G, I86T | 10429 | 1.06 | 0.733 |
| I13V, H15Q, R76G, I85F | 4736 | 0.48 | -0.04 |
| H15Q, S39I, R76G, V89D | Little or no protein produced | | |
| H15Q, S67L, R76G, I85F | 2869 | 0.29 | 0.025 |
| H15Q, T47A, Q72H, R76G, I86T | 32103 | 3.26 | 0.512 |
| H15Q, T47A, Q72H, R76G | 16500 | 1.68 | 0.327 |
| I13V, H15Q, T47A, Q72H, R76G | 73412 | 7.46 | 0.896 |
| H15Q, E44D, R76G, I85F | 2885 | 0.29 | −0.013 |
| H15Q, S39I, S67L, V89D | 45502 | 4.62 | 1.174 |
| H15Q, N32D, S67L, V89D | 25880 | 2.63 | 1.407 |
| N32D, S67L, V89D | 31753 | 3.23 | 1.155 |
| H15Q, S67L, Q72H, R76G, V89D | 40180 | 4.08 | 1.464 |
| H15Q, Q72H, Q74R, R76G, I86T | 4049 | 0.41 | 0.093 |
| G28V, Q72H, R76G, I86T | 5563 | 0.57 | 0.003 |
| I13V, H15Q, S39I, E44D, S67L | 63508 | 6.45 | 0.889 |
| E44D, S67L, Q72H, Q82R, V89D | 51467 | 5.23 | 1.061 |
| H15Q, V89D | 17672 | 1.8 | 0.31 |
| H15Q, T47A | 26578 | 2.7 | 0.016 |
| I13V, H15Q, Q82R | 76146 | 7.74 | 0.655 |
| I13V, H15Q, V89D | 28745 | 2.92 | 1.331 |
| I13V, S67L, Q82R, V89D | 58992 | 5.99 | 1.391 |
| I13V, H15Q, Q82R, V89D | 49523 | 5.03 | 1.419 |
| H15Q, V31M, S67L, Q82R, V89D | 67401 | 6.85 | 1.37 |
| I13V, H15Q, T47A, Q82R | 89126 | 9.05 | 0.652 |
| I13V, H15Q, V31A, N45S, Q82R, V89D | 68016 | 6.91 | 1.327 |
| H15Q, T47A, H69L, Q82R, V89D | 65598 | 6.66 | 1.44 |
| I13V, H15Q, T47A, H69L, R76G, V89D | 54340 | 5.52 | 1.719 |
| I12V, I13V, H15Q, T47A, Q82R, V89D | 61207 | 6.22 | 1.453 |
| I13V, H15Q, R76G, D77N, Q82R, V89D | 33079 | 3.36 | 0.065 |
| I13V, H15Q, T47A, R76G, V89D | 53668 | 5.45 | 1.596 |
| I13V, H15Q, T47A, Q82R, V89D | 63320 | 6.43 | 1.418 |
| I13V, H15Q, T47A, Q82R, V89D | 60980 | 6.2 | 1.448 |
| I13V, H15Q, I36V, T47A, S67L, V89D | 52835 | 5.37 | 1.627 |
| H15Q, T47A, K65R, S67L, Q82R, V89D | 79692 | 8.1 | 1.453 |
| H15Q, L33P, T47A, S67L, P71 S, V89D | 45726 | 4.65 | 1.467 |
| I13V, H15Q, Q72H, R76G, I86T | 24450 | 2.48 | 1.355 |
| H15Q, T47A, S67L, Q82R, V89D | 67962 | 6.9 | 1.479 |
| F2L, H15Q, D46E, T47A, Q72H, R76G, Q82R, V89D | 23039 | 2.34 | 1.045 |
| I13V, H15Q, L33F, T47A, Q82R, V89D | 62254 | 6.32 | 1.379 |
| H15Q, N24S, T47A, Q72H, R76G, V89D | 32077 | 3.26 | 0.4 |
| I13V, H15Q, E44V, T47A, Q82R, V89D | 61005 | 6.2 | 1.329 |
| H15Q, N18D, T47A, Q72H, V73A, R76G, I86T, V89D | 48317 | 4.91 | 0.475 |
| I13V, H15Q, T37A, E44D, S48C, S67L, Q82R, V89D | 47605 | 4.84 | 1.255 |
| H15Q, L33H, S67L, R76G, Q82R, V89D | 62326 | 6.33 | 1.507 |
| I13V, H15Q, T47A, Q72H, R76G, I86T | 49016 | 4.98 | 1.477 |
| H15Q, S39I, E44D, Q72H, V75G, R76G, Q82R, V89D | 43713 | 4.44 | 0.646 |
| H15Q, T47A, S67L, R76G, Q82R, V89D | 71897 | 7.3 | 1.539 |
| I13V, H15Q, T47A, S67L, Q72H, R76G, Q82R, V89D | 71755 | 7.29 | 1.536 |
| Wild Type PD-L2 IgV | 9843 | 1 | −0.024 |
| Full length ECD of PD-L2 | 2145 | 0.22 | 0.071 |
| Full length ECD of PD-L1 (R&D Systems) | 23769 | 2.41 | 1.263 |
| Anti-PD-1 monoclonal antibody (nivolumab) | 87002 | 8.84 | 0.899 |

TABLE E13B

Bioactivity Data of PD-L2 variants selected against PD-1 in MLR.

| PD-L2 mutation(s) | IFN gamma levels pg/mL | Fold increase over wildtype PD-L2 IgV-Fc |
|---|---|---|
| H15Q | 1817.1 | 1.32 |
| N24D | 1976.3 | 1.44 |
| E44D | 1499.4 | 1.09 |
| V89D | 1168.1 | 0.85 |
| Q82R, V89D | 1617 | 1.17 |
| E59G, Q82R | 1511.3 | 1.1 |
| S39I, V89D | 1314.5 | 0.95 |
| S67L, V89D | 1230.1 | 0.89 |
| S67L, I85F | 1281.9 | 0.93 |
| S67L, I86T | 1020.4 | 0.74 |
| H15Q, K65R | 1510.8 | 1.1 |
| H15Q, Q72H, V89D | 1272.2 | 0.92 |
| H15Q, S67L, R76G | 1426.2 | 1.04 |
| H15Q, R76G, I85F | 1725.7 | 1.25 |
| H15Q, T47A, Q82R | 1317.9 | 0.96 |
| H15Q, Q82R, V89D | 1081.2 | 0.79 |
| H15Q, C23S, I86T | 1847.2 | 1.34 |
| H15Q, S39I, I86T | 1415.2 | 1.03 |
| H15Q, R76G, I85F | 1437.8 | 1.04 |
| E44D, V89D, W91R | 1560.1 | 1.13 |
| I13V, S67L, V89D | 867.5 | 0.63 |
| H15Q, S67L, I86T | 1034.2 | 0.75 |
| I13V, H15Q, S67L, I86T | 1014.4 | 0.74 |
| I13V, H15Q, E44D, V89D | 1384.2 | 1.01 |
| I13V, S39I, E44D, Q82R, V89D | 935.6 | 0.68 |
| I13V, E44D, Q82R, V89D | 1009.5 | 0.73 |
| I13V, Q72H, R76G, I86T | 1953 | 1.42 |
| I13V, H15Q, R76G, I85F | 1528.5 | 1.11 |
| H15Q, S67L, R76G, I85F | 1318.7 | 0.96 |
| H15Q, T47A, Q72H, R76G, I86T | 1599.6 | 1.16 |
| H15Q, T47A, Q72H, R76G | 1462.5 | 1.06 |
| I13V, H15Q, T47A, Q72H, R76G | 1469.8 | 1.07 |
| H15Q, E44D, R76G, I85F | 1391.6 | 1.01 |
| H15Q, S39I, S67L, V89D | 1227 | 0.89 |
| H15Q, N32D, S67L, V89D | 1285.7 | 0.93 |
| N32D, S67L, V89D | 1194 | 0.87 |
| H15Q, S67L, Q72H, R76G, V89D | 1061.2 | 0.77 |
| H15Q, Q72H, Q74R, R76G, I86T | 933.8 | 0.68 |
| G28V, Q72H, R76G, I86T | 1781.6 | 1.29 |
| I13V, H15Q, S39I, E44D, S67L | 1256.9 | 0.91 |
| E44D, S67L, Q72H, Q82R, V89D | 1281.4 | 0.93 |
| H15Q, V89D | 1495.4 | 1.09 |
| H15Q, T47A | 1637.2 | 1.19 |
| I13V, H15Q, Q82R | 1432.9 | 1.04 |
| I13V, H15Q, V89D | 1123 | 0.82 |
| I13V, S67L, Q82R, V89D | 1372.8 | 1 |
| I13V, H15Q, Q82R, V89D | 1596.6 | 1.16 |
| H15Q, V31M, S67L, Q82R, V89D | 1206.5 | 0.88 |
| I13V, H15Q, T47A, Q82R | 1703.3 | 1.24 |
| I13V, H15Q, V31A, N45S, Q82R, V89D | 1723.1 | 1.25 |
| H15Q, T47A, H69L, Q82R, V89D | 1732.5 | 1.26 |
| I13V, H15Q, T47A, H69L, R76G, V89D | 1075.5 | 0.78 |
| I12V, I13V, H15Q, T47A, Q82R, V89D | 1533.2 | 1.11 |
| I13V, H15Q, R76G, D77N, Q82R, V89D | 1187.9 | 0.86 |
| I13V, H15Q, T47A, R76G, V89D | 1253.7 | 0.91 |
| I13V, H15Q, T47A, Q82R, V89D | 1445.5 | 1.05 |
| I13V, H15Q, T47A, Q82R, V89D | 1737 | 1.26 |
| I13V, H15Q, I36V, T47A, S67L, V89D | 1357.4 | 0.99 |
| H15Q, T47A, K65R, S67L, Q82R, V89D | 1335.3 | 0.97 |
| H15Q, L33P, T47A, S67L, P71 S, V89D | 1289.1 | 0.94 |
| I13V, H15Q, Q72H, R76G, I86T | 1221 | 0.89 |
| H15Q, T47A, S67L, Q82R, V89D | 1197.1 | 0.87 |
| F2L, H15Q, D46E, T47A, Q72H, R76G, Q82R, V89D | 1170.7 | 0.85 |
| I13V, H15Q, L33F, T47A, Q82R, V89D | 1468.4 | 1.07 |
| I13V, H15Q, T47A, E58G, S67L, Q82R, V89D | 836.1 | 0.61 |
| H15Q, N24S, T47A, Q72H, R76G, V89D | 1091.8 | 0.79 |
| I13V, H15Q, E44V, T47A, Q82R, V89D | 1270.5 | 0.92 |
| H15Q, N18D, T47A, Q72H, V73A, R76G, I86T, V89D | 1065.8 | 0.77 |
| I13V, H15Q, T37A, E44D, S48C, S67L, Q82R, V89D | 1751.7 | 1.27 |
| H15Q, L33H, S67L, R76G, Q82R, V89D | 1502 | 1.09 |
| I13V, H15Q, T47A, Q72H, R76G, I86T | 1088.1 | 0.79 |
| H15Q, S39I, E44D, Q72H, V75G, R76G, Q82R, V89D | 940.9 | 0.68 |
| H15Q, T47A, S67L, R76G, Q82R, V89D | 1097.8 | 0.8 |
| I13V, H15Q, T47A, S67L, Q72H, R76G, Q82R, V89D | 1559.6 | 1.13 |
| Wild Type PD-L2 IgV | 1376.8 | 1 |

TABLE E13B-continued

| Bioactivity Data of PD-L2 variants selected against PD-1 in MLR. | | |
|---|---|---|
| PD-L2 mutation(s) | IFN gamma levels pg/mL | Fold increase over wildtype PD-L2 IgV-Fc |
| Full length ECD of PD-L2 | 1173.2 | 0.85 |
| Full length ECD of PD-L1 | 2190.9 | 1.59 |
| Nivolumab (anti-PD-1) | 418.9 | 0.3 |

5. CD80 Binding and Bioactivity Data

Binding studies were carried out on cells that express the full-length mammalian surface ligands to assess binding of purified CD80 proteins to cell-expressed CTLA4, PD-L1, and CD28 counter structures. In some cases, second and third generations (Gen) of random mutagenesis and selection were run using procedures substantially described in Examples 8-10. Briefly, yeast plasmid DNA was isolated from outgrown yeast post FACS selection and used as template for mutagenic PCR. To maximize diversity, both characterized individual variants and a pool of FACS selected variants were used as template. The resulting library was subjected to iterative rounds of FACS selection and outgrowth. To increase PDL1 affinity while maintaining CD28 affinity, multiple FASC sort progression paths were taken. The second-generation mutagenic library underwent four FACS selections alternating between CD28− and CTLA4+ selections generating outputs that, when titrated against counter structures, were chosen to be reformatted into Fc vectors. The third-generation mutagenic library used the following FACS selection paths to yield yeast outputs that, when titrated against counter structures, were chosen to be reformatted into Fc vectors: 1. 50 nM PDL1+, 2a. 1 nM CTLA4+, 2b. 20 nM CTLA4−, 2a3. 10 nM PDL1+, 2b3. 10 nM PDL1+, 2b34. 25 nM CD28+. Following selection of yeast expressing affinity modified variants of CD80, the selected variants were reformatted as Fc fusion for the generation of additional Fc-fusion proteins containing IgV CD80 variants. After sequence analysis, individual variants were chosen for protein production, binding and functional assay.

For assessment of binding of selected immunomodulatory fusion proteins to cognate binding partners, cells expressing the CD80 cognate binding partners CTLA4 and PD-L1, full-length mammalian surface expression constructs were generated, incorporated into lentivirus and transduced into CHO cells. Cells were sorted in a Bio-Rad S3 Cell Sorter (Bio-Rad Corp., USA) to >98% purity. Jurkat/IL2 reporter cells, which endogenously express CD28, were used to detect binding to CD28. Staining and analysis by flow cytometry was performed essentially as described in section A.

TABLE E14A

Variant CD80 Binding to HEK293 Cells Transfected with CTLA4, CD28 or PD-L1

| | CTLA4 | | CD28 | | PD-L1 | | Ratio of |
|---|---|---|---|---|---|---|---|
| CD80 mutation(s) | MFI at 66.6 nM | Fold change to WT | MFI at 66.6 nM | Fold change to WT | MFI at 22.2 nM | Fold change to WT | CTLA4: CD28 |
| L70P | | | | Not tested | | | |
| I30F/L70P | | | | Not tested | | | |
| Q27H/T41S/A71D | 368176 | 2.3 | 25051 | 1.01 | 24181 | N/A | 14.7 |
| I30T/L70R | 2234 | 0.0 | 2596 | 0.10 | 5163 | N/A | 0.9 |
| T13R/C16R/L70Q/A71D | 197357 | 1.2 | 16082 | 0.65 | 9516 | N/A | 12.3 |
| T57I | 393810 | 2.4 | 23569 | 0.95 | 3375 | N/A | 16.7 |
| M43I/C82R | 3638 | 0.0 | 3078 | 0.12 | 7405 | N/A | 1.2 |
| V22L/M38V/M47T/A71D/L85M | 175235 | 1.1 | 3027 | 0.12 | 6144 | N/A | 57.9 |
| I30V/T57I/L70P/A71D/A91T | 116085 | 0.7 | 10129 | 0.41 | 5886 | N/A | 11.5 |
| V221/L70M/A71D | 163825 | 1.0 | 22843 | 0.92 | 33404 | N/A | 7.2 |
| N55D/L70P/E77G | | | | Not tested | | | |
| T57A/I69T | | | | Not tested | | | |
| N55D/K86M | 3539 | 0.0 | 3119 | 0.13 | 5091 | N/A | 1.1 |
| L72P/T79I | 50176 | 0.3 | 3397 | 0.14 | 6023 | N/A | 14.8 |
| L70P/F92S | 4035 | 0.0 | 2948 | 0.12 | 6173 | N/A | 1.4 |
| T79P | 2005 | 0.0 | 2665 | 0.11 | 4412 | N/A | 0.8 |
| E35D/M47I/L65P/D90N | 4411 | 0.0 | 2526 | 0.10 | 4034 | N/A | 1.7 |
| L25S/E35D/M47I/D90N | 61265 | 0.4 | 4845 | 0.20 | 20902 | N/A | 12.6 |
| A71D | 220090 | 1.4 | 16785 | 0.68 | 29642 | N/A | 13.1 |
| E81K/A91S | 98467 | 0.6 | 3309 | 0.13 | 44557 | N/A | 29.8 |
| A12V/M47V/L70M | 81616 | 0.5 | 7400 | 0.30 | 31077 | N/A | 11.0 |
| K34E/T41A/L72V | 88982 | 0.6 | 3755 | 0.15 | 35293 | N/A | 23.7 |
| T41S/A71D/V84A | 103010 | 0.6 | 5573 | 0.22 | 83541 | N/A | 18.5 |
| E35D/A71D | 106069 | 0.7 | 18206 | 0.73 | 40151 | N/A | 5.8 |
| E35D/M47I | 353590 | 2.2 | 14350 | 0.58 | 149916 | N/A | 24.6 |
| K36R/G78A | 11937 | 0.1 | 2611 | 0.11 | 5715 | N/A | 4.6 |
| Q33E/T41A | 8292 | 0.1 | 2442 | 0.10 | 3958 | N/A | 3.4 |
| M47V/N48H | 207012 | 1.3 | 14623 | 0.59 | 145529 | N/A | 14.2 |
| M47L/V68A | 74238 | 0.5 | 13259 | 0.53 | 11223 | N/A | 5.6 |
| S44P/A71D | 8839 | 0.1 | 2744 | 0.11 | 6309 | N/A | 3.2 |
| Q27H/M43I/A71D/R73S | 136251 | 0.8 | 12391 | 0.50 | 8242 | N/A | 11.0 |

TABLE E14A-continued

Variant CD80 Binding to HEK293 Cells Transfected with CTLA4, CD28 or PD-L1

| | CTLA4 | | CD28 | | PD-L1 | | Ratio of |
|---|---|---|---|---|---|---|---|
| CD80 mutation(s) | MFI at 66.6 nM | Fold change to WT | MFI at 66.6 nM | Fold change to WT | MFI at 22.2 nM | Fold change to WT | CTLA4: CD28 |
| E35D/T57I/L70Q/A71D | 121901 | 0.8 | 21284 | 0.86 | 2419 | N/A | 5.7 |
| M47I/E88D | 105192 | 0.7 | 7337 | 0.30 | 97695 | N/A | 14.3 |
| M421/161V/A71D | 54478 | 0.3 | 6074 | 0.24 | 4226 | N/A | 9.0 |
| P51A/A71D | 67256 | 0.4 | 4262 | 0.17 | 5532 | N/A | 15.8 |
| H18Y/M47I/T57I/A71G | 136455 | 0.8 | 20081 | 0.81 | 13749 | N/A | 6.8 |
| V201/M47V/T571/V841 | 183516 | 1.1 | 26922 | 1.08 | 3583 | N/A | 6.8 |
| WT CD80 ECD-Fc | 161423 | 1.0 | 24836 | 1.00 | Not tested | N/A | 6.5 |
| Fc only | 5962 | | 2592 | | 4740 | | |

TABLE E14B

Variant CD80 Binding to HEK293 Cells Transfected with CTLA4, CD28 or PD-L1

| | CTLA4 | | CD28 | | PD-L1 | | Ratio of |
|---|---|---|---|---|---|---|---|
| CD80 mutation(s) | MFI at 66.6 nM | Fold change to WT | MFI at 66.6 nM | Fold change to WT | MFI at 22.2 nM | Fold change to WT | CTLA4: CD28 |
| V201/M47V/A71D | 149937 | 7.23 | 15090 | 9.33 | 9710 | 5.48 | 9.9 |
| A71D/L72V/E95K | 140306 | 6.77 | 6314 | 3.90 | 8417 | 4.75 | 22.2 |
| V22L/E35G/A71D/L72P | 152588 | 7.36 | 8150 | 5.04 | 1403 | 0.79 | 18.7 |
| E35D/A71D | 150330 | 7.25 | 14982 | 9.26 | 13781 | 7.77 | 10.0 |
| E35D/I67L/A71D | 146087 | 7.04 | 11175 | 6.91 | 9354 | 5.28 | 13.1 |
| T13R/M42V/M47I/A71D | 108900 | 5.25 | 16713 | 10.33 | 1869 | 1.05 | 6.5 |
| E35D | 116494 | 5.62 | 3453 | 2.13 | 25492 | 14.38 | 33.7 |
| E35D/M47I/L70M | 116531 | 5.62 | 14395 | 8.90 | 49131 | 27.71 | 8.1 |
| E35D/A71/L72V | 134252 | 6.47 | 11634 | 7.19 | 13125 | 7.40 | 11.5 |
| E35D/M43L/L70M | 102499 | 4.94 | 3112 | 1.92 | 40632 | 22.92 | 32.9 |
| A26P/E35D/M43I/L85Q/ E88D | 83139 | 4.01 | 5406 | 3.34 | 9506 | 5.36 | 15.4 |
| E35D/D46V/L85Q | 85989 | 4.15 | 7510 | 4.64 | 38133 | 21.51 | 11.4 |
| Q27L/E35D/M47I/T57I/ L70Q/E88D | 59793 | 2.88 | 14011 | 8.66 | 1050 | 0.59 | 4.3 |
| Q27H/E35G/A71D/L72P/ T79I | 85117 | 4.10 | 10317 | 6.38 | 1452 | 0.82 | 8.3 |
| M47V/I69F/A71D/V83I | 76944 | 3.71 | 15906 | 9.83 | 3399 | 1.92 | 4.8 |
| E35D/T57A/A71D/L85Q | 85724 | 4.13 | 3383 | 2.09 | 1764 | 0.99 | 25.3 |
| H18Y/A26T/E35D/A71D/ L85Q | 70878 | 3.42 | 6487 | 4.01 | 8026 | 4.53 | 10.9 |
| E35D/M47L | 82410 | 3.97 | 11508 | 7.11 | 58645 | 33.08 | 7.2 |
| E23D/M42V/M43I/I58V/ L70R | 37331 | 1.80 | 10910 | 6.74 | 2251 | 1.27 | 3.4 |
| V68M/L70M/A71D/E95K | 56479 | 2.72 | 10541 | 6.51 | 38182 | 21.53 | 5.4 |
| N55I/T57I/I69F | 2855 | 0.14 | 1901 | 1.17 | 14759 | 8.32 | 1.5 |
| E35D/M43I/A71D | 63789 | 3.08 | 6369 | 3.94 | 27290 | 15.39 | 10.0 |
| T41S/T57I/L70R | 59844 | 2.89 | 4902 | 3.03 | 19527 | 11.01 | 12.2 |
| H18Y/A71D/L72P/E88V | 68391 | 3.30 | 8862 | 5.48 | 1085 | 0.61 | 7.7 |
| V20I/A71D | 60323 | 2.91 | 10500 | 6.49 | 3551 | 2.00 | 5.7 |
| E23G/A26S/E35D/T62N/ A71D/L72V/L85M | 59025 | 2.85 | 5484 | 3.39 | 10662 | 6.01 | 10.8 |
| A12T/E24D/E35D/D46V/ I61V/L72P/E95V | 63738 | 3.07 | 7411 | 4.58 | 1221 | 0.69 | 8.6 |
| V22L/E35D/M43L/A71G/ D76H | 2970 | 0.14 | 1498 | 0.93 | 1851 | 1.04 | 2.0 |
| E35G/K54E/A71D/L72P | 71899 | 3.47 | 3697 | 2.29 | 1575 | 0.89 | 19.4 |
| L70Q/A71D | 45012 | 2.17 | 18615 | 11.50 | 1692 | 0.95 | 2.4 |
| A26E/E35D/M47L/L85Q | 40325 | 1.94 | 2266 | 1.40 | 55548 | 31.33 | 17.8 |
| D46E/A71D | 69674 | 3.36 | 16770 | 10.36 | 22777 | 12.85 | 4.2 |
| Y31H/E35D/T41S/V68L/ K93R/R94W | 3379 | 0.16 | 2446 | 1.51 | 18863 | 10.64 | 1.4 |
| WT CD80 IgV-Fc (inert) | 20739 | 1.00 | 1618 | 1.00 | 1773 | 1.00 | 12.8 |
| WT CD80 ECD-Fc (inert) | 72506 | 3.50 | 3072 | 1.90 | 4418 | 2.49 | 23.6 |

TABLE E14C

Variant CD80 Flow Binding to Jurkat Cells (CD28) and CHO cells stably expressing CTLA4 or PD-L1

| | CTLA4 | | CD28 | | PD-L1 | | Ratio of |
|---|---|---|---|---|---|---|---|
| CD80 mutation(s) | MFI at 33.3 nM | Fold change to WT CD80 | MFI at 33.3 nM | Fold change to WT | MFI at 33.3 nM | Fold change to WT | PD-L1: CD28 |
| A26E/Q33R/E35D/M47L/L85Q/K86E | 1275 | 0.01 | 275 | 0.04 | 75974 | 9.56 | 276 |
| A26E/Q33R/E35D/M47L/L85Q | 1280 | 0.01 | 264 | 0.03 | 81533 | 10.26 | 309 |
| E35D/M47L/L85Q | 336179 | 1.88 | 646 | 0.08 | 33200 | 4.18 | 51 |
| A26E/Q33L/E35D/M47L/L85Q | 1172 | 0.01 | 274 | 0.04 | 62680 | 7.89 | 229 |
| A26E/Q33L/E35D/M47L | 1316 | 0.01 | 271 | 0.04 | 60903 | 7.67 | 225 |
| H18Y/A26E/Q33L/E35D/M47L/L85Q | 2088 | 0.01 | 272 | 0.04 | 76591 | 9.64 | 282 |
| Q33L/E35D/M47I | 15919 | 0.09 | 282 | 0.04 | 37353 | 4.70 | 132 |
| H18Y/Q33L/E35D/M47I | 5539 | 0.03 | 295 | 0.04 | 47793 | 6.02 | 162 |
| Q33L/E35D/D46E/M47I | 23328 | 0.13 | 281 | 0.04 | 42137 | 5.30 | 150 |
| Q33R/E35D/D46E/M47I | 3562 | 0.02 | 303 | 0.04 | 53345 | 6.72 | 176 |
| H18Y/E35D/M47L | 284445 | 1.59 | 5068 | 0.66 | 44161 | 5.56 | 9 |
| Q33L/E35D/M47V | 47648 | 0.27 | 281 | 0.04 | 47911 | 6.03 | 170 |
| Q33L/E35D/M47V/T79A | 28899 | 0.16 | 285 | 0.04 | 62078 | 7.82 | 218 |
| Q33L/E35D/T41S/M47V | 14515 | 0.08 | 287 | 0.04 | 43850 | 5.52 | 153 |
| Q33L/E35D/M47I/L85Q | 20548 | 0.11 | 287 | 0.04 | 63930 | 8.05 | 222 |
| Q33L/E35D/M47I/T62N/L85Q | 1658 | 0.01 | 284 | 0.04 | 72578 | 9.14 | 256 |
| Q33L/E35D/M47V/L85Q | 75368 | 0.42 | 268 | 0.04 | 47438 | 5.97 | 177 |
| A26E/E35D/M43T/M47L/L85Q/R94Q | 278021 | 1.56 | 260 | 0.03 | 68089 | 8.57 | 262 |
| Q33R/E35D/K37E/M47V/L85Q | 22701 | 0.13 | 258 | 0.03 | 44438 | 5.59 | 172 |
| V22A/E23D/Q33L/E35D/M47V | 3636 | 0.02 | 274 | 0.04 | 75513 | 9.51 | 275 |
| E24D/Q33L/E35D/M47V/K54R/L85Q | 310964 | 1.74 | 3180 | 0.42 | 67066 | 8.44 | 21 |
| S15P/Q33L/E35D/M47L/L85Q | 22377 | 0.13 | 266 | 0.03 | 51558 | 6.49 | 194 |
| E7D/E35D/M47I/L97Q | 270798 | 1.52 | 273 | 0.04 | 14643 | 1.84 | 54 |
| Q33L/E35D/T41S/M43I | 6388 | 0.04 | 433 | 0.06 | 44935 | 5.66 | 104 |
| E35D/M47I/K54R/L85E | 8665 | 0.05 | 285 | 0.04 | 36917 | 4.65 | 130 |
| Q33K/E35D/D46V/L85Q | 8507 | 0.05 | 257 | 0.03 | 26676 | 3.36 | 104 |
| Y31S/E35D/M47L/T79L/E88G | 1095 | 0.01 | 278 | 0.04 | 38909 | 4.90 | 140 |
| H18L/V22A/E35D/M47L/N48T/L85Q | 373548 | 2.09 | 434 | 0.06 | 98110 | 12.35 | 226 |
| Q27H/E35D/M47L/L85Q/R94Q/E95K | 288596 | 1.61 | 282 | 0.04 | 36055 | 4.54 | 128 |
| Q33K/E35D/M47V/K89E/K93R | 1752 | 0.01 | 276 | 0.04 | 39061 | 4.92 | 142 |
| E35D/M47I/E77A/L85Q/R94W | 247334 | 1.38 | 272 | 0.04 | 64521 | 8.12 | 238 |
| A26E/E35D/M43I/M47L/L85Q/K86E/R94W | 2947 | 0.02 | 314 | 0.04 | 49440 | 6.22 | 157 |
| Q27H/Q33L/E35D/M47V/N55D/L85Q/K89N | 56061 | 0.31 | 269 | 0.04 | 14802 | 1.86 | 55 |
| H18Y/V20A/Q33L/E35D/M47V/Y53F | 2878 | 0.02 | 260 | 0.03 | 120517 | 15.17 | 463 |
| V22A/E35D/V68E/A71D | 437038 | 2.45 | 13987 | 1.83 | 1350 | 0.17 | 0 |
| Q33L/E35D/M47L/A71G/F92S | 2107 | 0.01 | 366 | 0.05 | 28041 | 3.53 | 77 |
| V22A/R29H/E35D/D46E/M47I | 77423 | 0.43 | 323 | 0.04 | 25407 | 3.20 | 79 |
| Q33L/E35D/M43I/L85Q/R94W | 1083 | 0.01 | 272 | 0.04 | 29001 | 3.65 | 107 |
| H18Y/E35D/V68M/L97Q | 172538 | 0.97 | 299 | 0.04 | 121591 | 15.31 | 407 |
| Q33L/E35D/M47L/V68M/L85Q/E88D | 3526 | 0.02 | 264 | 0.03 | 125741 | 15.83 | 476 |
| Q33L/E35D/M43V/M47I/A71G | 13964 | 0.08 | 284 | 0.04 | 78029 | 9.82 | 275 |
| E35D/M47L/A71G/L97Q | 225591 | 1.26 | 300 | 0.04 | 65944 | 8.30 | 220 |
| E35D/M47V/A71G/L85M/L97Q | 239089 | 1.34 | 339 | 0.04 | 61708 | 7.77 | 182 |
| H18Y/Y31H/E35D/M47V/A71G/L85Q | 3835 | 0.02 | 268 | 0.04 | 76364 | 9.61 | 285 |
| E35D/D46E/M47V/L97Q | 305331 | 1.71 | 371 | 0.05 | 19484 | 2.45 | 52 |
| E35D/D46V/M47I/A71G/F92V | 287194 | 1.61 | 7543 | 0.99 | 45755 | 5.76 | 6 |

TABLE E14C-continued

Variant CD80 Flow Binding to Jurkat Cells (CD28) and CHO cells stably expressing CTLA4 or PD-L1

| | CTLA4 | | CD28 | | PD-L1 | | Ratio of |
|---|---|---|---|---|---|---|---|
| CD80 mutation(s) | MFI at 33.3 nM | Fold change to WT CD80 | MFI at 33.3 nM | Fold change to WT | MFI at 33.3 nM | Fold change to WT | PD-L1: CD28 |
| E35D/M47V/T62A/A71G/ V83A/Y87H/L97M | 18113 | 0.10 | 305 | 0.04 | 77547 | 9.76 | 255 |
| Q33L/E35D/N48K/L85Q/ L97Q | 1183 | 0.01 | 279 | 0.04 | 45185 | 5.69 | 162 |
| WT CD80 ECD-Fc (R&D) | 178708 | 1.00 | 7627 | 1.00 | 7943 | 1.00 | 1 |

TABLE E14D

Variant CD80 Flow Binding to Jurkat Cells (CD28) and CHO cells stably expressing CTLA4 or PD-L1

| | CTLA4 | | CD28 | | PD-L1 | | Ratio of |
|---|---|---|---|---|---|---|---|
| CD80 mutation(s) | MFI at 33.3 nM | Fold change to WT CD80 | MFI at 33.3 nM | Fold change to WT CD80 | MFI at 33.3 nM | Fold change to WT CD80 | PD-L1: CD28 |
| E35D/L85Q/K93T/E95V/ L97Q | 246401 | 1.57 | 400 | 0.02 | 19880 | 1.67 | 50 |
| E35D/M47V/N48K/V68M/ K89N | 807 | 0.01 | 11736 | 0.65 | 89775 | 7.56 | 8 |
| Q33L/E35D/M47I/N48D/ A71G | 116798 | 0.74 | 644 | 0.04 | 31151 | 2.62 | 48 |
| R29H/E35D/M43V/M47I/ I49V | 4694 | 0.03 | 336 | 0.02 | 1590 | 0.13 | 5 |
| Q27H/E35D/M47I/L85Q/ D90G | 257734 | 1.64 | 3513 | 0.19 | 30667 | 2.58 | 9 |
| E35D/M47I/L85Q/D90G | 247703 | 1.57 | 4095 | 0.23 | 35710 | 3.01 | 9 |
| E35D/M47I/T62S/L85Q | 300845 | 1.91 | 1758 | 0.10 | 44975 | 3.79 | 26 |
| A26E/E35D/M47L/A71G | 341248 | 2.17 | 2161 | 0.12 | 53352 | 4.49 | 25 |
| E35D/M47I/Y87Q/K89E | 110177 | 0.70 | 15452 | 0.86 | 29803 | 2.51 | 2 |
| V22A/E35D/M47I/Y87N | 245711 | 1.56 | 15299 | 0.85 | 35251 | 2.97 | 2 |
| HI8Y/A26E/E35D/M47L/ L85Q/D90G | 230588 | 1.47 | 3540 | 0.20 | 52390 | 4.41 | 15 |
| E35D/M47L/A71G/L85Q | 156254 | 0.99 | 1436 | 0.08 | 50474 | 4.25 | 35 |
| E35D/M47V/A71G/E88D | 211831 | 1.35 | 6237 | 0.35 | 37146 | 3.13 | 6 |
| E35D/A71G | 184204 | 1.17 | 4299 | 0.24 | 34149 | 2.88 | 8 |
| E35D/M47V/A71G | 226532 | 1.44 | 6360 | 0.35 | 36216 | 3.05 | 6 |
| I30V/E35D/M47V/A71G/ A91V | 204756 | 1.30 | 5779 | 0.32 | 43877 | 3.70 | 8 |
| V22D/E35D/M47L/L85Q | 256426 | 1.63 | 542 | 0.03 | 34908 | 2.94 | 64 |
| H18Y/E35D/N48K | 260795 | 1.66 | 4189 | 0.23 | 45849 | 3.86 | 11 |
| E35D/T41S/M47V/A71G/ K89N | 251238 | 1.60 | 5314 | 0.29 | 45436 | 3.83 | 9 |
| E35D/M47V/N48T/L85Q | 281417 | 1.79 | 692 | 0.04 | 35491 | 2.99 | 51 |
| E35D/D46E/M47V/A71D/ D90G | 274661 | 1.75 | 6169 | 0.34 | 32371 | 2.73 | 5 |
| E35D/D46E/M47V/A71D | 174016 | 1.11 | 5949 | 0.33 | 549 | 0.05 | 0 |
| E35D/T41S/M43I/A71G/ D90G | 208017 | 1.32 | 9249 | 0.51 | 56172 | 4.73 | 6 |
| E35D/T41S/M43I/M47V/ A71G | 243502 | 1.55 | 2845 | 0.16 | 44419 | 3.74 | 16 |
| E35D/T41S/M43I/M47L/ A71G | 209034 | 1.33 | 3104 | 0.17 | 59613 | 5.02 | 19 |
| H18Y/V22A/E35D/M47V/ T62S/A71G | 219782 | 1.40 | 4214 | 0.23 | 87702 | 7.39 | 21 |
| H18Y/A26E/E35D/M47L/ V68M/A71G/D90G | 253787 | 1.61 | 14934 | 0.83 | 170935 | 14.40 | 11 |
| E35D/K37E/M47V/N48D/ L85Q/D90N | 243506 | 1.55 | 1589 | 0.09 | 26542 | 2.24 | 17 |
| Q27H/E35D/D46V/M47L/ A71G | 157358 | 1.00 | 10412 | 0.58 | 60139 | 5.07 | 6 |
| V22L/Q27H/E35D/M47I/ A71G | 151600 | 0.96 | 7269 | 0.40 | 43797 | 3.69 | 6 |
| E35D/D46V/M47L/V68M/ L85Q/E88D | 224734 | 1.43 | 5027 | 0.28 | 137368 | 11.57 | 27 |
| E35D/T41S/M43V/M47I/ L70M/A71G | 249456 | 1.59 | 2698 | 0.15 | 12978 | 1.09 | 5 |
| E35D/D46E/M47V/N63D/ L85Q | 274320 | 1.74 | 1331 | 0.07 | 69780 | 5.88 | 52 |
| E35D/M47V/T62A/A71D/ K93E | 225737 | 1.44 | 12030 | 0.67 | 693 | 0.06 | 0 |

TABLE E14D-continued

Variant CD80 Flow Binding to Jurkat Cells (CD28) and CHO cells stably expressing CTLA4 or PD-L1

| CD80 mutation(s) | CTLA4 MFI at 33.3 nM | CTLA4 Fold change to WT CD80 | CD28 MFI at 33.3 nM | CD28 Fold change to WT CD80 | PD-L1 MFI at 33.3 nM | PD-L1 Fold change to WT CD80 | Ratio of PD-L1: CD28 |
|---|---|---|---|---|---|---|---|
| E35D/D46E/M47V/V68M/D90G/K93E | 273157 | 1.74 | 27080 | 1.50 | 71903 | 6.06 | 3 |
| E35D/M43I/M47V/K89N | 278391 | 1.77 | 6752 | 0.37 | 19250 | 1.62 | 3 |
| E35D/M47L/A71G/L85M/F92Y | 215998 | 1.37 | 2459 | 0.14 | 46684 | 3.93 | 19 |
| E35D/M42V/M47V/E52D/L85Q | 225986 | 1.44 | 1291 | 0.07 | 11897 | 1.00 | 9 |
| V22D/E35D/M47L/L70M/L97Q | 127835 | 0.81 | 527 | 0.03 | 17670 | 1.49 | 34 |
| E35D/T41S/M47V/L97Q | 262204 | 1.67 | 290 | 0.02 | 13591 | 1.14 | 47 |
| E35D/Y53H/A71G/D90G/L97R | 182701 | 1.16 | 1547 | 0.09 | 57455 | 4.84 | 37 |
| E35D/A71D/L72V/R73H/E81K | 186582 | 1.19 | 3365 | 0.19 | 503 | 0.04 | 0 |
| Q33L/E35D/M431/Y53F/T62S/L85Q | 3985 | 0.03 | 1024 | 0.06 | 72065 | 6.07 | 70 |
| E35D/M38T/D46E/M47V/N48S | 175387 | 1.11 | 587 | 0.03 | 19393 | 1.63 | 33 |
| Q33R/E35D/M47V/N48K/L85M/F92L | 2680 | 0.02 | 265 | 0.01 | 21425 | 1.80 | 81 |
| E35D/M38T/M43V/M47V/N48R/L85Q | 203938 | 1.30 | 285 | 0.02 | 21795 | 1.84 | 76 |
| T28Y/Q33H/E35D/D46V/M47I/A71G | 156810 | 1.00 | 298 | 0.02 | 46038 | 3.88 | 154 |
| WT CD80 ECD-Fc (R&D) | 157306 | 1.00 | 18035 | 1.00 | 11871 | 1.00 | 1 |

TABLE E14E

Variant CD80 selected against CD28. Molecule sequences, binding data, and costimulatory bioactivity data.

| CD80 mutation(s) | Binding CD28 MFI (parental ratio) | Binding CTLA-4 MFI (parental ratio) | Binding PD-L1 MFI (parental ratio) | Coimmobilization with anti-CD3 IFN-gamma pg/ml (parental ratio) | MLR IFN-gamma levels pg/ml (parental ratio) |
|---|---|---|---|---|---|
| L70Q/A91G/N144D | 125 (1.31) | 283 (1.36) | 6 (0.08) | 93 (1.12) | 716 (0.83) |
| L70Q/A91G/T130A | 96 (1.01) | 234 (1.13) | 7 (0.10) | 99 (1.19) | 752 (0.87) |
| L70Q/A91G/I118A/T120S/T130A/K169E | 123 (1.29) | 226 (1.09) | 7 (0.10) | 86 (1.03) | 741 (0.86) |
| V4M/L70Q/A91G/I118V/T120S/T130A/K169E | 89 (0.94) | 263 (1.26) | 6 (0.09) | 139 (1.67) | 991 (1.14) |
| L70Q/A91G/I118V/T120S/T130A/K169E | 106 (1.12) | 263 (1.26) | 6 (0.09) | 104 (1.25) | 741 (0.86) |
| V20L/L70Q/A91S/I118V/T120S/T130A | 105 (1.11) | 200 (0.96) | 9 (0.13) | 195 (2.34) | 710 (0.82) |
| S44P/L70Q/A91G/T130A | 88 (0.92) | 134 (0.64) | 5 (0.07) | 142 (1.71) | 854 (0.99) |
| L70Q/A91G/E117G/I118V/T120S/T130A | 120 (1.27) | 193 (0.93) | 6 (0.08) | 98 (1.05) | 736 (0.85) |
| A91G/T120S/I118V/T130A | 84 (0.89) | 231 (1.11) | 44 (0.62) | 276 (3.33) | 714 (0.82) |
| L70R/A91G/I118V/T120S/T130A/T199S | 125 (1.32) | 227 (1.09) | 6 (0.09) | 105 (1.26) | 702 (0.81) |
| L70Q/E81A/A91G/I118V/T120S/1127T/T130A | 140 (1.48) | 185 (0.89) | 18 (0.25) | 98 (1.18) | 772 (0.89) |
| L70Q/Y87N/A91G/T130A | 108 (1.13) | 181 (0.87) | 6 (0.08) | 136 (1.63) | 769 (0.89) |
| T28S/L70Q/A91G/E95K/I118V/T120S/I126V/T130A/K169E | 32 (0.34) | 65 (0.31) | 6 (0.08) | 120 (1.44) | 834 (0.96) |
| N63S/L70Q/A91G/S114T/I118V/T120S/T130A | 124 (1.30) | 165 (0.79) | 6 (0.08) | 116 (1.39) | 705 (0.81) |
| K36E/I67T/L70Q/A91G/I118V/T120S/T130A/N152T | 8 (0.09) | 21 (0.10) | 5 (0.08) | 53 (0.63) | 852 (0.98) |

TABLE E14E-continued

Variant CD80 selected against CD28. Molecule sequences, binding data, and costimulatory bioactivity data.

| CD80 mutation(s) | Binding: CD28 MFI (parental ratio) | Binding: CTLA-4 MFI (parental ratio) | Binding: PD-L1 MFI (parental ratio) | Coimmobilization with anti-CD3: IFN-gamma pg/ml (parental ratio) | MLR IFN-gamma levels pg/ml (parental ratio) |
|---|---|---|---|---|---|
| E52G/L70Q/A91G/D107N/I118V/T120S/T130A/K169E | 113 (1.19) | 245 (1.18) | 6 (0.08) | 94 (1.13) | 874 (1.01) |
| K37E/F59S/L70Q/A91G/T120S/T130A | 20 (0.21) | 74 (0.36) | 6 (0.08) | 109 (1.31) | 863 (1.00) |
| A91G/S103P | 39 (0.41) | 56 (0.27) | 9 (0.13) | 124 (1.49) | 670 (0.77) |
| K89E/T130A | 90 (0.95) | 148 (0.71) | 75 (1.07) | 204 (2.45) | 761 (0.88) |
| A91G | 96 (1.01) | 200 (0.96) | 85 (1.21) | 220 (2.65) | 877 (1.01) |
| D60V/A91G/I118V/T120S/T130A/K169E | 111 (1.17) | 222 (1.07) | 12 (0.18) | 120 (1.44) | 744 (0.86) |
| K54M/L70Q/A91G/Y164H | 68 (0.71) | 131 (0.63) | 5 (0.08) | 152 (1.83) | 685 (0.79) |
| M38T/L70Q/E77G/A91G/I118V/T120S/T130A/N152T | 61 (0.64) | 102 (0.49) | 5 (0.07) | 119 (1.43) | 796 (0.92) |
| R29H/E52G/L70R/E88G/A91G/T130A | 100 (1.05) | 119 (0.57) | 5 (0.08) | 200 (2.41) | 740 (0.85) |
| Y31H/T41G/M43L/L70Q/A91G/I118V/T120S//I126V/T130A | 85 (0.89) | 85 (0.41) | 6 (0.08) | 288 (3.47) | 782 (0.90) |
| V68A/T110A | 103 (1.08) | 233 (1.12) | 48 (0.68) | 163 (1.96) | 861 (0.99) |
| L65H/D90G/T110A/F116L | 33 (0.35) | 121 (0.58) | 11 (0.15) | 129 (1.55) | 758 (0.88) |
| R29H/E52G/D90N/I118V/T120S/T130A | 66 (0.69) | 141 (0.68) | 11 (0.15) | 124 (1.49) | 800 (0.92) |
| A91G/L102S | 6 (0.06) | 6 (0.03) | 5 (0.08) | 75 (0.90) | 698 (0.81) |
| I67T/L70Q/A91G/I118V/T120S | 98 (1.03) | 160 (0.77) | 5 (0.08) | 1751 (21.1) | 794 (0.92) |
| L70Q/A91G/T110A/I118V/T120S/T130A | 8 (0.09) | 14 (0.07) | 5 (0.07) | 77 (0.93) | 656 (0.76) |
| M38V/T41D/M43I/W50G/D76G/V83A/K89E/I118V/T 120S/1126V/T130A | 5 (0.06) | 8 (0.04) | 8 (0.11) | 82 (0.99) | 671 (0.78) |
| V22A/L70Q/S121P | 5 (0.06) | 7 (0.04) | 5 (0.07) | 105 (1.27) | 976 (1.13) |
| A12V/S15F/Y31H/M38L/T41G/M43L/D90N/T130A/P137L/N149D/N152T | 6 (0.06) | 6 (0.03) | 5 (0.08) | 104 (1.25) | 711 (0.82) |
| I67F/L70R/E88G/A91G/I118V/T120S/T130A | 5 (0.05) | 6 (0.03) | 6 (0.08) | 62 (0.74) | 1003 (1.16) |
| E24G/L25P/L70Q/A91G/I118V/T120S/N152T | 26 (0.27) | 38 (0.18) | 8 (0.11) | 101 (1.21) | 969 (1.12) |
| A91G/F92L/F108L/I118V/T120S | 50 (0.53) | 128 (0.61) | 16 (0.11) | 59 (0.71) | 665 (0.77) |
| WT CD80 | 95 (1.00) | 208 (1.00) | 70 (1.00) | 83 (1.00) | 866 (1.00) |

TABLE E14F

Variant CD80 selected against PD-L1. Molecule sequences, binding data, and costimulatory bioactivity data.

| | Binding | | | Coimmobilization with anti-CD3 | MLR |
|---|---|---|---|---|---|
| CD80 mutation(s) | CD28 MFI (parental ratio) | CTLA-4 MFI (parental ratio) | PD-L1 MFI (parental ratio) | IFN-gamma pg/ml (parental ratio) | IFN-gamma levels pg/ml (parental ratio) |
| R29D/Y31L/Q33H/K36G/M38I/T41A/M43R/M47T/E81V/L85R/K89N/A91T/F92P/K93V/R94L/I118T/N149S | 1071 (0.08) | 1089 (0.02) | 37245 (2.09) | 387 (0.76) | 5028 (0.26) |
| R29D/Y31L/Q33H/K36G/M38I/T41A/M43R/M47T/E81V/L85R/K89N/A91T/F92P/K93V/R94L/N144S/N149S | 1065 (0.08) | 956 (0.02) | 30713 (1.72) | 400 (0.79) | 7943 (0.41) |
| R29D/Y31L/Q33H/K36G/M38I/T41A/M42T/M43R/M47T/E81V/L85R/K89N/A91T/F92P/K93V/R94L/L148S/N149S | 926 (0.07) | 954 (0.02) | 47072 (2.64) | 464 (0.91) | 17387 (0.91) |
| E24G/R29D/Y31L/Q33H/K36G/M38I/T41A/M43R/M47T/F59L/E81V/L85R/K89N/A91T/F92P/K93V/R94L/H96R/N149S/C182S | 1074 (0.08) | 1022 (0.02) | 1121 (0.06) | 406 (0.80) | 13146 (0.69) |
| R29D/Y31L/Q33H/K36G/M38I/T41A/M43R/M47T/E81V/L85R/K89N/A91T/F92P/K93V/R94L/N149S | 1018 (0.08) | 974 (0.02) | 25434 (1.43) | 405 (0.80) | 24029 (1.25) |
| R29V/M43Q/E81R/L85I/K89R/D90L/A91E/F92N/K93Q/R94G | 1029 (0.08) | 996 (0.02) | 1575 (0.09) | 342 (0.67) | 11695 (0.61) |
| T41I/A91G | 17890 (1.35) | 50624 (1.01) | 12562 (0.70) | 433 (0.85) | 26052 (1.36) |
| E88D/K89R/D90K/A91G/F92Y/K93R/N122S/N177S | 41687 (3.15) | 49429 (0.99) | 20140 (1.13) | 773 (1.52) | 6345 (0.33) |
| E88D/K89R/D90K/A91G/F92Y/K93R | 51663 (3.91) | 72214 (1.44) | 26405 (1.48) | 1125 (2.21) | 9356 (0.49) |
| K36G/K37Q/M38I/L40M/F59L/E81V/L85R/K89N/A91T/F92P/K93V/R94L/E99G/T130A/N149S | 1298 (0.10) | 1271 (0.03) | 3126 (0.18) | 507 (1.00) | 3095 (0.16) |
| E88D/K89R/D90K/A91G/F92Y/K93R | 31535 (2.38) | 50868 (1.02) | 29077 (1.63) | 944 (1.85) | 5922 (0.31) |
| K36G/K37Q/M38I/L40M | 1170 (0.09) | 1405 (0.03) | 959 (0.05) | 427 (0.84) | 811 (0.04) |
| K36G/L40M | 29766 (2.25) | 58889 (1.18) | 20143 (1.13) | 699 (1.37) | 30558 (1.59) |
| WT CD80 | 13224 (1.00) | 50101 (1.00) | 17846 (1.00) | 509 (1.00) | 19211 (1.00) |

6. ICOSL Binding and Bioactivity Data

Binding was assessed to cells expressed full-length cognate binding partners CD28, ICOS and CTLA-4 substantially as described above in section A. Bioactivity of the ECD ICOSL variants also was assessed in an anti-CD3 coimmobilization assay or human Mixed Lymphocyte Reaction (MLR) substantially as described above, except that for the coimmobilization assay, costimulatory activity was determined by culture of human T cells with a mixture of 10 nM plate-bound anti-CD3 and 40 nM ICOSL Fc variant proteins.

TABLE E15A

ICOSL variants selected against CD28 or ICOS. Molecule sequences, binding data, and costimulatory bioactivity data.

| ICOSL mutation(s) | Binding: ICOS OD (parental ratio) | Binding: CD28 MFI (parental ratio) | Coimmobilization with anti-CD3 IFN-gamma pg/ml (parental ratio) | MLR IFN-gamma levels pg/ml (parental ratio) |
|---|---|---|---|---|
| N52S | 1.33 (1.55) | 162 (9.00) | 1334 (1.93) | 300 (0.44) |
| N52H | 1.30 (1.51) | 368 (20.44) | 1268 (1.83) | 39 (0.06) |
| N52D | 1.59 (1.85) | 130 (7.22) | 1943 (2.80) | 190 (0.28) |
| N52Y/N57Y/F138L/L203P | 1.02 (1.19) | 398 (22.11) | 510* (1.47*) | 18 (0.03) |
| N52H/N57Y/Q100P | 1.57 (1.83) | 447 (24.83) | 2199 (3.18) | 25 (0.04) |
| N52S/Y146C/Y152C | 1.26 (1.47) | 39 (2.17) | 1647 (2.38) | 152 (0.22) |
| N52H/C198R | 1.16 (1.35) | 363 (20.17) | 744* (2.15*) | ND (ND) |
| N52H/C140del/T225A | ND (ND) | 154 (8.56) | 522* (1.51*) | ND (ND) |
| N52H/C198R/T225A | 1.41 (1.64) | 344 (19.11) | 778* (2.25*) | 0 (0) |
| N52H/K92R | 1.48 (1.72) | 347 (19.28) | 288* (0.83*) | 89 (0.13) |
| N52H/S99G | 0.09 (0.10) | 29 (1.61) | 184* (0.53*) | 421 (0.61) |
| N52Y | 0.08 (0.09) | 18 (1.00) | 184* (0.53*) | 568 (0.83) |
| N57Y | 1.40 (1.63) | 101 (5.61) | 580* (1.68*) | 176 (0.26) |
| N57Y/Q100P | 0.62 (0.72) | 285 (15.83) | 301* (0.87*) | 177 (0.26) |
| N52S/S130G/Y152C | 0.16 (0.19) | 24 (1.33) | 266* (0.77*) | 1617 (2.35) |
| N52S/Y152C | 0.18 (0.21) | 29 (1.61) | 238* (0.69*) | 363 (0.53) |
| N52S/C198R | 1.80 (2.09) | 82 (4.56) | 1427 (2.06) | 201 (0.29) |
| N52Y/N57Y/Y152C | 0.08 (0.09) | 56 (3.11) | 377* (1.09*) | 439 (0.64) |
| N52Y/N57Y/H129P/C198R | ND (ND) | 449 (24.94) | 1192 (1.72) | ND (ND) |
| N52H/L161P/C198R | 0.18 (0.21) | 343 (19.05) | 643* (1.86*) | 447 (0.65) |
| N52S/T113E | 1.51 (1.76) | 54 (3.00) | 451* (1.30*) | 345 (0.50) |
| S54A | 1.62 (1.88) | 48 (2.67) | 386* (1.12*) | 771 (1.12) |
| N52D/S54P | 1.50 (1.74) | 38 (2.11) | 476* (1.38*) | 227 (0.33) |
| N52K/L208P | 1.91 (2.22) | 291 (16.17) | 1509 (2.18) | 137 (0.20) |
| N52S/Y152H | 0.85 (0.99) | 68 (3.78) | 2158 (3.12) | 221 (0.32) |
| N52D/V151A | 0.90 (1.05) | 19 (1.06) | 341* (0.99*) | 450 (0.66) |
| N52H/I143T | 1.83 (2.13) | 350 (19.44) | 2216 (3.20) | 112 (0.16) |
| N52S/L80P | 0.09 (0.10) | 22 (1.22) | 192* (0.55*) | 340 (0.49) |
| F120S/Y152H/N201S | 0.63 (0.73) | 16 (0.89) | 351* (1.01*) | 712 (1.04) |
| N52S/R75Q/L203P | 1.71 (1.99) | 12 (0.67) | 1996 (2.88) | 136 (0.20) |
| N52S/D158G | 1.33 (1.55) | 39 (2.17) | 325* (0.94*) | 277 (0.40) |
| N52D/Q133H | 1.53 (1.78) | 104 (5.78) | 365* (1.05*) | 178 (0.26) |
| WT ICOSL | 0.86 (1.00) | 18 (1.00) | 692/346* (1.00) | 687 (1.00) |

TABLE E15B

ICOSL variants: binding data and costimulatory bioactivity data.

| ICOSL mutation(s) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/ml (parental ratio) | MLR IFN-gamma pg/ml (parental ratio) |
|---|---|---|---|---|---|
| N52H, F78L, Q100R, C198R | 9568 (0.12) | 1966 (0.24) | 1454 (0.12) | 130 (0.31) | 5927 (1.84) |
| N52H, N57Y, Q100R, V110D, C198R, S212G | 9418 (1.16) | 136665 (16.55) | 115352 (9.59) | 944 (2.21) | 821 (0.25) |
| N52H, N57Y, R75Q, Q100P, V110D | 5558 (0.07) | 7465 (0.90) | 4689 (0.39) | 122 (0.28) | 1136 (0.35) |
| N52H, N57Y, Q100R, C198R | 9148 (1.13) | 134923 (16.33) | 83241 (6.92) | 1060 (2.48) | 375 (0.12) |
| N52H, N57Y, L74Q, V110D, S192G | 9448 (1.17) | 128342 (15.54) | 123510 (10.26) | 1137 (2.66) | 889 (0.28) |
| N52H, Q100R | 9478 (1.17) | 151977 (18.40) | 133929 (11.13) | 972 (2.28) | 794 (0.25) |
| N52H, S121G, C198R | 9128 (1.13) | 124732 (15.10) | 182607 (15.18) | 827 (1.94) | 1257 (0.39) |
| A20V, N52H, N57Y, Q100R, S109G | 5828 (0.72) | 76973 (9.32) | 73640 (6.12) | 447 (1.05) | 2283 (0.71) |
| N52H, N57Y, Q100P, C198R | 9548 (1.18) | 130676 (15.82) | 81966 (6.81) | 1125 (2.64) | 643 (0.20) |
| N52H, N57Y, R61S, Q100R, V110D, L173S | 1018 (0.13) | 9129 (1.11) | 5790 (0.48) | 109 (0.25) | 5094 (1.58) |
| N52H, N57Y, Q100R, V122A | 9978 (1.23) | 137372 (16.63) | 70764 (5.88) | 1316 (3.08) | 473 (0.15) |
| N52H, N57Y, Q100R, F172S | 1028 (1.27) | 135821 (16.44) | 73320 (6.09) | 1561 (3.66) | 486 (0.15) |
| N52H, N57Y, Q100R | 9858 (1.22) | 140612 (17.02) | 75106 (6.24) | 1648 (3.86) | 778 (0.24) |
| N52S, F120S, N227K | 9438 (1.17) | 67796 (8.21) | 82370 (6.85) | 1157 (2.71) | 1626 (0.50) |
| N52S, N194D | 9798 (1.21) | 59431 (7.19) | 74502 (6.19) | 1671 (3.91) | 1690 (0.52) |
| N52S, V97A | 3138 (0.04) | 1733 (0.21) | 1541 (0.13) | 84 (0.20) | 3858 (1.20) |
| N52S, F120S | 9068 (1.12) | 67233 (8.14) | 97880 (8.13) | 1178 (2.76) | 2814 (0.87) |
| N52S, G72R | 9288 (1.15) | 51638 (6.25) | 62339 (5.18) | 1161 (2.72) | 2947 (0.91) |
| N52S, A71T, A117T, T190A, C198R | 8918 (1.10) | 44044 (5.33) | 56646 (4.71) | 1076 (2.52) | 4031 (1.25) |
| N52S, E220G | 3878 (0.05) | 2047 (0.25) | 1796 (0.15) | 122 (0.29) | 1927 (0.60) |
| Y47H, N52S, V107A, F120S | 3268 (0.04) | 2562 (0.31) | 2104 (0.17) | 334 (0.78) | 4390 (1.36) |
| WT ICOSL | 8088 (1.00) | 8260 (1.00) | 12033 (1.00) | 427 (1.00) | 3226 (1.00) |
| T43A, N52H, N57Y, L74Q, D89G, V110D, F172S | 2821 (0.02) | 2180 (0.49) | 2051 (0.12) | 184 (0.75) | |
| N52H, N57Y, Q100R, V107I, V110D, S132F, I154F, C198R, R221G | 174586 (0.97) | 122383 (27.24) | 76202 (4.31) | 985 (4.01) | 1037 (0.36) |
| E16V, N52H, N57Y, Q100R, V110D, H115R, Y152C, K156M, C198R | 190765 (1.05) | 129070 (28.73) | 68488 (3.87) | 4288 (17.46) | 1225 (0.43) |
| Q37R, N52H, N57Y, Q100R, V110N, S142F, C198R, D217V, R221G | 148638 (0.82) | 91104 (20.28) | 13498 (0.76) | 62 (0.25) | 7643 (2.68) |
| N52H, N57Y, Q100R, V110D, C198R | 179194 (0.99) | 123312 (27.45) | 84136 (4.76) | 762 (3.10) | 1342 (0.47) |
| N52H, N57Y, Q100R, | 5236 | 4160 | 3305 | 49 | 2039 |

TABLE E15B-continued

ICOSL variants: binding data and costimulatory bioactivity data.

| ICOSL mutation(s) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/ml (parental ratio) | MLR IFN-gamma pg/ml (parental ratio) |
|---|---|---|---|---|---|
| V110D, V116A, L161M, F172S, S192G, C198R | (0.03) | (0.93) | (0.19) | (0.20) | (0.72) |
| F27S, N52H, N57Y, V110N | 20154 (0.11) | 8613 (1.92) | 3903 (0.22) | 83 (0.34) | 7522 (2.64) |
| F27S, N52H, N57Y, V110N | 5236 (0.03) | 4160 (0.93) | 2957 (0.17) | 40 (0.16) | — |
| N52S, H94E, L96I, S109N, L166Q | 198604 (1.10) | 100361 (22.34) | 102892 (5.82) | 1253 (5.10) | 5645 (1.98) |
| S18R, N52S, F93L, I143V, R221G | 154561 (0.85) | 7625 (1.70) | 4254 (0.24) | 203 (0.83) | 5239 (1.84) |
| A20T, N52D, Y146C, Q164L | 149661 (0.83) | 9073 (2.02) | 6901 (0.39) | 287 (1.17) | 4829 (1.69) |
| V11E, N30D, N52H, N57Y, H94E, L96I, L98F, N194D, V210A, I218T | 180016 (1.00) | 120230 (26.76) | 62809 (3.55) | 2218 (9.03) | 7283 (2.56) |
| N52S, H94E, L96I, V122M | 198717 (1.10) | 88901 (19.79) | 94231 (5.33) | 590 (2.40) | 618 (0.22) |
| N52H, N57Y, H94E, L96I, F120I, S126T, W153R, I218N | 87711 (0.48) | 42035 (9.36) | 31798 (1.80) | 67 (0.27) | 2500 (0.88) |
| M10V, S18R, N30D, N52S, S126R, T139S, L203F | 180665 (1.00) | 64929 (14.45) | 48362 (2.73) | 1193 (4.86) | 13647 (4.79) |
| S25G, N30D, N52S, F120S, N227K | 178834 (0.99) | 66127 (14.72) | 46631 (2.64) | 1246 (5.07) | 2202 (0.77) |
| N30D, N52S, L67P, Q100K, D217G, R221K, T225S | 18630 (0.10) | 1986 (0.44) | 1940 (0.11) | 54 (0.22) | 2752 (0.97) |
| WT ICOSL | 180900 (1.00) | 4493 (1.00) | 17685 (1.00) | 246 (1.00) | 2850 (1.00) |
| N52H, N57Y, Q100R, V110D, A117T, T190S, C198R | 2831 (0.04) | 2881 (0.57) | 2464 (0.23) | 59 (0.08) | — |
| N52H, N57Y, Q100R, V110D, F172S, CW8R | 58478 (0.79) | 74031 (14.75) | 56850 (5.33) | 712 (0.96) | 1093 (0.23) |
| S25G, F27C, N52H, N57Y, Q100R, V110D, E135K, L173S, CW8R | 22514 (0.30) | 21320 (4.25) | 20450 (1.92) | 353 (0.48) | 5765 (1.21) |
| N52H, N57Y, V110A, CW8R, R221I | 84236 (1.14) | 81842 (16.31) | 121519 (11.39) | 4593 (6.18) | 1137 (0.24) |
| M10I, S13G, N52H, N57Y, D77G, V110A, H129P, I143V, F172S, V193M, CW8R | 6362 (0.09) | 6001 (1.20) | 4834 (0.45) | 141 (0.19) | 4326 (0.91) |
| N52H, N57Y, R61C, Y62F, Q100R, V110N, F120S, CW8R | 4355 (0.06) | 4316 (0.86) | 3430 (0.32) | 110 (0.15) | 6854 (1.44) |
| N52H, N57Y, Q100R, L102R, V110D, H115R, CW8R | 96736 (1.31) | 77881 (15.52) | 148012 (13.88) | 8765 (11.79) | 630 (0.13) |
| N52H, N57Y, Q100R, V110D, N144D, F172S, CW8R | 67578 (0.91) | 64953 (12.94) | 95731 (8.98) | 1672 (2.52) | 1490 (0.31) |
| N52S, H94E, L98F, Q100R | 80690 (1.09) | 78750 (15.69) | 148160 (13.89) | 3564 (4.80) | 1497 (0.32) |
| N52S, E90A | 108908 (1.47) | 31086 (6.19) | 108866 (10.21) | 4564 (6.14) | 3927 (0.83) |
| N30D, K42E, N52S | 85726 (1.16) | 4293 (0.86) | 10755 (1.01) | 5211 (7.01) | 5656 (1.19) |
| N52S, F120S, | 90862 | 28443 | 105229 | 4803 | 4357 |

TABLE E15B-continued

ICOSL variants: binding data and costimulatory bioactivity data.

| ICOSL mutation(s) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/ml (parental ratio) | MLR IFN-gamma pg/ml (parental ratio) |
|---|---|---|---|---|---|
| I143V, I224V | (1.23) | (5.67) | (9.87) | (6.46) | (0.92) |
| WT ICOSL | 73964 (1.00) | 5018 (1.00) | 10665 (1.00) | 743 (1.00) | 4748 (1.00) |

TABLE E15C

Molecule sequences, binding data, and costimulatory bioactivity data of variant ICOSLECD-Fc molecules containing select mutations

| | Binding | | | Coimmobilization with anti-CD3 IFN- |
|---|---|---|---|---|
| ICOSL Mutations | ICOS MFI (parental ratio) | CD28 MFI (parental ratio) | CTLA-4 MFI (parental ratio) | gamma pg/mL (parental ratio) |
| N52H, N57Y, Q100R, F172S, C198R | 118145 (1.33) | 59651 (29.60) | 178790 (41.12) | 5059 (37.90) |
| N52H, N57Y, Q100R, H115R, F172S, C198R | 125341 (1.41) | 51604 (25.60) | 211000 (48.53) | 8218 (61.57) |
| N52Y, N57Y, Q100P, F172S | 121280 (1.37) | 63663 (31.59) | 174224 (40.07) | 8123 (60.86) |
| E16V, N52H, N57Y, Q100R, V110D, H115R, Y152C, K156M, F172S, C198R | 107819 (1.22) | 68883 (34.18) | 170080 (39.12) | 8936 (66.95) |
| N52S, H115R, F120S, I143V, C198R | 116235 (1.31) | 25582 (12.69) | 22483 (5.17) | 125 (0.93) |
| N52H, N57Y, Q100P, C198R | 107164 (1.21) | 56103 (27.84) | 172319 (39.63) | 1258 (9.43) |
| N52H, N57Y, Q100P, H115R, F172S, C198R | 120864 (1.36) | 54586 (27.08) | 176637 (40.63) | 5507 (41.26) |
| N52H, N57Y, Q100P, F172S, C198R | 117954 (1.33) | 59376 (29.46) | 151265 (34.79) | 3884 (29.10) |
| N52H, N57Y, Q100P, H115R | 126221 (1.42) | 53321 (26.46) | 178812 (41.13) | 4154 (31.13) |
| N52H, N57Y, Q100P, H115R, C198R | 137004 (1.55) | 55454 (27.51) | 148417 (34.14) | 5069 (37.98) |
| N52H, Q100R, C198R | 111428 (1.26) | 58608 (29.08) | 116111 (26.71) | 3729 (27.94) |
| N52H, Q100R, H115R, F172S | 105532 (1.19) | 58287 (28.92) | 106295 (24.45) | 5294 (39.67) |
| N52H, Q100R, H115X, F172S, C198R | 106555 (1.20) | 73397 (36.42) | 171815 (39.52) | 6961 (52.16) |
| N52H, Q100R, H115R, F172S, C198R | 114223 (1.29) | 66686 (33.09) | 157154 (36.15) | 7592 (56.88) |
| N52H, N57Y, Q100R, F172S, C198R | 99350 (1.12) | 61292 (30.41) | 182288 (41.93) | 9167 (68.68) |
| N52H, N57Y, Q100R, H115R, F172S, C198R | 114057 (1.29) | 52011 (25.81) | 146471 (33.69) | 6545 (49.04) |
| N52H, N57Y, Q100R, H115R, F172S | 136143 (1.54) | 66516 (33.00) | 177376 (40.80) | 8527 (63.89) |
| N52H, N57Y, Q100R, H115R, F172S, C198R | 132970 (1.50) | 59633 (29.59) | 133247 (30.65) | 5999 (44.95) |
| Q100R | 62064 (8.31) | 16740 (8.31) | 29654 (8.31) | 35 (0.26) |

TABLE E15C-continued

Molecule sequences, binding data, and costimulatory bioactivity data of variant ICOSLECD-Fc molecules containing select mutations

| | Binding | | | Coimmobilization with anti-CD3 IFN- |
|---|---|---|---|---|
| ICOSL Mutations | ICOS MFI (parental ratio) | CD28 MFI (parental ratio) | CTLA-4 MFI (parental ratio) | gamma pg/mL (parental ratio) |
| Q100R ΔAAA | 1594 (8.20) | 16535 (8.20) | 33457 (8.20) | 87 (0.65) |
| F138L L203P | 53804 (0.75) | 1510 (0.75) | 2151 (0.75) | 35 (0.26) |
| F138L L203P ΔAAA | 53044 (0.93) | 1882 (0.93) | 1623 (0.93) | 35 (0.26) |
| N52Y F138L L203P | 99761 (23.50) | 47369 (23.50) | 67300 (23.50) | 1489 (11.16) |
| N52Y F138L L203P ΔAAA | 59576 (26.23) | 52865 (26.23) | 66553 (26.23) | 997 (7.47) |
| N57Y Q100R C198R | 58706 (28.65) | 57739 (28.65) | 99426 (28.65) | 9962 (74.64) |
| N57Y Q100R C198R ΔAAA | 98514 (28.63) | 57694 (28.63) | 131458 (28.63) | 6763 (50.67) |
| N57Y F138L L203P | 109472 (20.98) | 42276 (20.98) | 64477 (20.98) | 4979 (37.30) |
| N57Y F138L L203P ΔAAA | 97777 (22.29) | 44924 (22.29) | 64742 (22.29) | 6507 (48.75) |
| N52H | 91598 (28.91) | 58264 (28.91) | 103025 (28.91) | 3393 (25.42) |
| N57Y | 109031 (21.71) | 43754 (21.71) | 50683 (21.71) | 4881 (36.57) |
| N57Y, Q100P | 72480 (29.85) | 60161 (29.85) | 109522 (29.85) | 2797 (20.95) |
| Q100R, F138L | 65974 (2.23) | 4485 (2.23) | 8136 (2.23) | 685 (5.13) |
| L203P | 61554 (0.76) | 1533 (0.76) | 2031 (0.76) | 2434 (18.24) |
| Wildtype ICOSL ECD | 88625 (1.00) | 2015 (1.00) | 4348 (1.00) | 133 (1.00) |

TABLE E15D

Molecule sequences, binding data, and costimulatory bioactivity data of variant ICOSLECD-Fc molecules containing select mutations

| | Binding | | | Coimmobilization with anti-CD3 IFN- |
|---|---|---|---|---|
| ICOSL Mutations | ICOS MFI (parental ratio) | CD28 MFI (parental ratio) | CTLA-4 MFI (parental ratio) | gamma pg/mL (parental ratio) |
| N52H, N57Y, Q100R, H115R | 165027 (1.97) | 51666 (9.89) | 287581 (60.27) | 5858 (20.36) |
| N52H, N57Y, Q100R, F172S | 184449 (2.20) | 51394 (9.84) | 182109 (38.16) | 3449 (11.99) |
| N52H, N57Y, Q100R, H115R, F172S, 1224V | 165120 (1.97) | 46636 (8.93) | 274026 (57.43) | 2053 (7.13) |
| N52H, N57Y, Q100R, H115R, F172S | 164750 (1.97) | 40046 (7.67) | 259351 (54.35) | 3722 (12.93) |
| N52H, N57Y, Q100R, H115R, C198R | 186017 (2.22) | 39073 (7.48) | 200505 (42.02) | 3909 (13.58) |
| N52H, N57Y, Q100R, F172S, C198R | 181118 (2.16) | 38233 (7.32) | 210709 (44.16) | 1199 (4.17) |
| N52H, N57Y, Q100R, H115R, F172S, C198R | 155392 (1.85) | 28828 (5.52) | 169736 (35.57) | 3449 (11.99) |
| N52H, N57Y, Q100R, H115R, I143V, F172S, C198R | 139977 (1.67) | 31459 (6.02) | 179089 (37.53) | 1620 (5.63) |

TABLE E15D-continued

Molecule sequences, binding data, and costimulatory bioactivity data of variant ICOSLECD-Fc molecules containing select mutations

| ICOSL Mutations | Binding ICOS MFI (parental ratio) | CD28 MFI (parental ratio) | CTLA-4 MFI (parental ratio) | Coimmobilization with anti-CD3 IFN-gamma pg/mL (parental ratio) |
|---|---|---|---|---|
| N52H, N57Y, Q100R, L102R H115R, F172S, C198R | 146799 (1.75) | 29636 (5.68) | 200000 (41.91) | 2712 (9.43) |
| N52H, N57Y, Q100R, H115R F172S, N194D | 150863 (1.80) | 31304 (5.99) | 167783 (35.16) | 15607 (54.24) |
| N52H, N57Y, H115R, F172S, C198R | 126909 (1.51) | 35803 (6.86) | 152858 (32.03) | 5374 (18.67) |
| N52H, N57Y, Q100R, H115R, C198R | 131730 (1.57) | 37595 (7.20) | 139041 (29.14) | 9306 (32.34) |
| N52H, N57Y, H115R | 162632 (1.94) | 49847 (9.55) | 266878 (55.93) | 2918 (10.14) |
| N52H, Q100R, H115R, I143T F172S | 132873 (1.59) | 52058 (9.97) | 186366 (39.06) | 3086 (10.72) |
| N52H, N57Y, Q100P, H115R, F172S | 148160 (1.77) | 46851 (8.97) | 246636 (51.69) | 4987 (17.33) |
| E16V, N52H, N57Y, Q100R, V110D, H115R, C198R | 154036 (1.84) | 48674 (9.32) | 212905 (44.62) | 5095 (17.71) |
| N52S, E90A, H115R | 142963 (1.71) | 3597 (0.69) | 3772 (0.79) | 2241 (7.79) |
| N30D, K42E, N52S, H115R, C198R R221I | 124095 (1.48) | 8066 (1.54) | 7751 (1.62) | 417 (1.45) |
| N30D, K42E, N52S, H115R, C198R | 161734 (1.93) | 2791 (0.53) | 2919 (0.61) | 841 (2.92) |
| N30D, K42E, N52S, H115R, F172S, N194D | 117880 (1.41) | 4395 (0.84) | 4941 (1.04) | 2904 (10.09) |
| N30D, K42E, N52S, H115R, | 114107 (1.36) | 2935 (0.56) | 2748 (0.58) | 549 (1.91) |
| N52S, E90A, H115R, | 120450 (1.44) | 12768 (2.45) | 23282 (4.88) | 2890 (10.04) |
| N30D, K42E, N52S, H115R | 115273 (1.38) | 11964 (2.29) | 22779 (4.77) | 2241 (7.79) |
| N52S, H115R, F172S, C198R | 95537 (1.14) | 7614 (1.46) | 21701 (4.55) | 1458 (5.07) |
| Wildtype | 83813 (1.00) | 5222 (1.00) | 4772 (1.00) | 288 (1.00) |

TABLE E15E

Molecule sequences, binding data, and costimulatory bioactivity data of variant ICOSLECD-Fc molecules containing glycosylation mutations

| ICOSL Mutation(s) | Binding ICOS MFI (parental ratio) | CD28 MFI (parental ratio) | CTLA-4 MFI (parental ratio) | Coimmobilization with anti-CD3 IFN-gamma pg/mL (parental ratio) |
|---|---|---|---|---|
| N84Q | 34426 (0.94) | 1755 (1.16) | 5757 (1.51) | 100 (2.03) |
| N119Q | 30806 (0.84) | 4102 (2.70) | 19836 (5.21) | 81 (1.66) |
| N168Q | 27041 (0.74) | 1410 (0.93) | 18641 (4.90) | 67 (1.36) |
| N207Q | 36516 (1.00) | 11923 (7.86) | 25701 (6.76) | 206 (4.20) |
| N52Q, N207X | 30216 (0.83) | 12086 (7.97) | 27952 (7.35) | 77 (1.56) |
| N168X, N207X | 37191 (1.02) | 5787 (3.81) | 12280 (3.23) | 104 (2.12) |
| N52Q, N168Q | 32576 (0.89) | 12638 (8.33) | 27167 (7.14) | 101 (2.06) |
| N84Q, N207Q | 37176 (1.02) | 5292 (3.49) | 3153 (0.83) | 31 (0.63) |
| N155Q, N207Q | 34884 (0.95) | 1489 (0.98) | 987 (0.26) | 73 (1.48) |

TABLE E15E-continued

Molecule sequences, binding data, and costimulatory bioactivity data of variant ICOSLECD-Fc molecules containing glycosylation mutations

| ICOSL Mutation(s) | Binding ICOS MFI (parental ratio) | CD28 MFI (parental ratio) | CTLA-4 MFI (parental ratio) | Coimmobilization with anti-CD3 IFN-gamma pg/mL (parental ratio) |
|---|---|---|---|---|
| N119Q, N168Q | 29099 (0.80) | 2534 (1.67) | 11289 (2.97) | 51 (1.05) |
| N119Q, N207Q | 32603 (0.89) | 1861 (1.23) | 6795 (1.79) | 153 (3.12) |
| N119Q N155X | 38516 (1.05) | 15318 (10.10) | 27498 (7.23) | 173 (3.52) |
| N52Q, N84Q | 33988 (0.93) | 1675 (1.10) | 3525 (0.93) | 39 (0.80) |
| N52Q, N119Q | 35729 (0.98) | 11040 (7.28) | 26139 (6.87) | 51 (1.03) |
| N84Q, N119Q | 34777 (0.95) | 1493 (0.98) | 2877 (0.76) | 39 (0.80) |
| N52Q, N84Q, N168Q | 27021 (0.74) | 1584 (1.04) | 958 (0.25) | 38 (0.78) |
| N52Q, N84Q, N207Q | 39942 (1.09) | 13396 (8.83) | 26360 (6.93) | 37 (0.76) |
| N84Q, N155Q, N168Q | 27812 (0.76) | 357 (0.24) | 466 (0.12) | 30 (0.61) |
| N84Q, N168Q, N207Q | 30659 (0.84) | 737 (0.49) | 861 (0.23) | 25 (0.52) |
| N84Q, N155H, N207Q | 13557 (0.37) | 685 (0.45) | 607 (0.16) | 29 (0.59) |
| N155Q, N168Q, N207Q | 13999 (0.38) | 277 (0.18) | 317 (0.08) | 40 (0.82) |
| N119Q, N155Q, N168Q | 36896 (1.01) | 4094 (2.70) | 2179 (0.57) | 50 (1.02) |
| N119Q, N168Q, N207Q | 29543 (0.81) | 921 (0.61) | 3744 (0.98) | 72 (1.47) |
| N84Q, N119Q, N207Q | 21357 (0.58) | 569 (0.38) | 640 (0.17) | 59 (1.20) |
| N119Q, N155H, N207Q | 37310 (1.02) | 614 (0.40) | 931 (0.24) | 86 (1.75) |
| N84Q, N119Q, N155Q | 2675 (0.07) | 262 (0.17) | 291 (0.08) | 34 (0.70) |
| N52Q, N119Q, N155Q | 27853 (0.76) | 552 (0.36) | 772 (0.20) | 42 (0.87) |
| N52H, N84Q, N119Q | 40700 (1.11) | 4580 (3.02) | 4601 (1.21) | 39 (0.80) |
| N52H, N84Q, N168X, N207X | 8796 (0.24) | 587 (0.39) | 481 (0.13) | 32 (0.66) |
| N52Q, N84Q, N155X, N168X | 43521 (1.19) | 6605 (4.35) | 4811 (1.26) | 32 (0.66) |
| N52Q, N84Q, N119Q, N168Q | 39342 (1.07) | 4519 (2.98) | 3300 (0.87) | 37 (0.76) |
| N52Q, N84Q, N119Q, N207Q | 7011 (0.19) | 602 (0.40) | 433 (0.11) | 37 (0.75) |
| Wildtype ICOSL ECD | 36602 (1.00) | 1517 (1.00) | 3804 (1.00) | 49 (1.00) |

TABLE E15F

Additional exemplary variant ICOSL polypeptides

| Mutations | Binding CD28 MFI (ΔWT) | CTLA-4 MFI (ΔWT) | ICOS MFI (ΔWT) | Costim IFN-gamma pg/mL (ΔWT) | MLR IFN-gamma pg/mL (ΔWT) |
|---|---|---|---|---|---|
| N52A/N57F/Q100S | 156589 (7.00) | 255078 (0.77) | 241891 (1.14) | 1119 (0.68) | 0 (0.00) |
| N52A/N57H/Q100S | 159363 (7.10) | 321437 (0.97) | 304600 (1.44) | 2972 (1.80) | 0 (0.00) |
| N52A/N57Y/Q100 A | 147258 (6.60) | 319745 (0.97) | 260713 (1.23) | 2978 (1.81) | 0 (0.00) |
| N52D,/N57A/ Q100A | 137882 (6.20) | 340186 (1.03) | 248975 (1.17) | 477 (0.29) | 134 (0.60) |

TABLE E15F-continued

| Additional exemplary variant ICOSL polypeptides | | | | | |
|---|---|---|---|---|---|
| | Binding | | | Costim IFN- | MLR IFN- |
| Mutations | CD28 MFI (ΔWT) | CTLA-4 MFI (ΔWT) | ICOS MFI (ΔWT) | gamma pg/mL (ΔWT) | gamma pg/mL (ΔWT) |
| N52D,/Q100S | 95731 (4.30) | 332743 (1.01) | 275097 (1.30) | 957 (0.58) | 110 (0.49) |
| N52G/Q100A | 98652 (4.40) | 97118 (0.29) | 303229 (1.43) | 296 (0.18) | 96 (0.43) |
| N52H/Q100A | 145762 (6.50) | 361334 (1.09) | 213008 (1.01) | 784 (0.48) | 37 (0.17) |
| N52M/N57H/Q100S | 114743 (5.10) | 463404 (1.40) | 265637 (1.25) | 1333 (0.81) | 0 (0.00) |
| N52M/N57W/Q100P | 168057 (7.50) | 342659 (1.04) | 322277 (1.52) | 1865 (1.13) | 0 (0.00) |
| N52Q/N57F | 131301 (5.90) | 366714 (1.11) | 192206 (0.91) | 1403 (0.85) | 0 (0.00) |
| N52Q/N57S/Q100A | 91306 (4.10) | 315021 (0.95) | 262735 (1.24) | 290 (0.18) | 123 (0.55) |
| N52R/N57L/Q100A | 118803 (5.30) | 402961 (1.22) | 307965 (1.45) | 709 (0.43) | 0 (0.00) |
| N52R/N57Y/Q100P | 133283 (6.00) | 502179 (1.52) | 251264 (1.19) | 7380 (4.48) | 0 (0.00) |
| N52R/N57Y/Q100S | 133454 (6.00) | 504037 (1.53) | 229271 (1.08) | 5841 (3.54) | 0 (0.00) |
| N52S/N57A/Q100A | 98153 (4.40) | 233184 (0.71) | 181297 (0.86) | 442 (0.27) | 52 (0.23) |
| N52S/N57H/Q100E | 116821 (5.20) | 302383 (0.92) | 257518 (1.22) | 8412 (5.11) | 132 (0.59) |
| N52S/N57L/Q100S | 108133 (4.80) | 197064 (0.60) | 268940 (1.27) | 3120 (1.89) | 0 (0.00) |
| N52S/N57M/Q100S | 133604 (6.00) | 227615 (0.69) | 312088 (1.47) | 349 (0.21) | 199 (0.89) |
| N52S/N57Y/Q100S | 161330 (7.20) | 204577 (0.62) | 223684 (1.06) | 7411 (4.50) | 0 (0.00) |
| N52S/N57Y/Q100M | 156869 (7.00) | 395350 (1.20) | 302569 (1.43) | 2954 (1.79) | 0 (0.00) |
| N52S/N57Y/Q100V | 126281 (5.70) | 304795 (0.92) | 218925 (1.03) | 1304 (0.79) | 0 (0.00) |
| N52T/N57H/Q100S | 143441 (6.40) | 377542 (1.14) | 258634 (1.22) | 6312 (3.83) | 0 (0.00) |
| N52T/N57H/Q100A | 112637 (5.00) | 350453 (1.06) | 220339 (1.04) | 2874 (1.74) | 0 (0.00) |
| N52T/N57Y/Q100A | 161333 (7.20) | 340845 (1.03) | 239136 (1.13) | 442 (0.27) | 0 (0.00) |
| N52V/N57L/Q100A | 132144 (5.90) | 252148 (0.76) | 181344 (0.86) | 518 (0.31) | 159 (0.71) |
| N52H/N57Y/Q100K | 141720 (6.30) | 393476 (1.19) | 214270 (1.01) | 12919 (7.84) | 0 (0.00) |
| N52K/N57Y/Q100R | 140729 (6.30) | 233283 (0.71) | 198941 (0.94) | 12515 (7.60) | 0 (0.00) |
| N52L/N57H/Q100R | 140807 (6.30) | 352518 (1.07) | 250052 (1.18) | 12544 (7.61) | 0 (0.00) |
| N52R/N57F/Q100N | 161029 (7.20) | 233254 (0.71) | 252904 (1.19) | 448 (0.27) | 106 (0.47) |
| N52R/N57F/Q100P | 153850 (6.90) | 503696 (1.52) | 296566 (1.40) | 1718 (1.04) | 0 (0.00) |
| N52R/N57F/Q100R | 185231 (8.30) | 463873 (1.40) | 234248 (1.11) | 11402 (6.92) | 0 (0.00) |
| N52R/N57F/Q100T | 126875 (5.70) | 357505 (1.08) | 270134 (1.27) | 272 (0.17) | 0 (0.00) |
| N52R/N57H/Q100K | — | — | — | — | — |
| N52R/N57L/Q100S | 111704 (5.00) | 289326 (0.88) | 230617 (1.09) | 1292 (0.78) | 0 (0.00) |
| N52R/N57W/Q100K | 130875 (5.90) | 477268 (1.44) | 349316 (1.65) | 10056 (6.10) | 0 (0.00) |
| N52R/N57W | 136967 (6.10) | 318199 (0.96) | 298850 (1.41) | 12652 (7.68) | 0 (0.00) |
| N52R/N57Y/Q100R | 3285 (0.10) | 4266 (0.01) | 6104 (0.03) | 349 (0.21) | 347 (1.54) |
| N52C/N57E/Q100S | 13361 (0.60) | 10616 (0.03) | 125274 (0.59) | 296 (0.18) | 372 (1.65) |
| N52G/N57P/Q100D | 5715 (0.30) | 10181 (0.03) | 274629 (1.30) | 254 (0.15) | 343 (1.53) |
| N52G/N57V/Q100G | 23658 (1.10) | 14727 (0.04) | 260057 (1.23) | 325 (0.20) | 245 (1.09) |
| N52G/N57V | 69117 (3.10) | 52498 (0.16) | 332068 (1.57) | 847 (0.51) | 327 (1.45) |
| N52L/N57V | 54775 (2.50) | 150970 (0.46) | 256730 (1.21) | 986 (0.60) | 270 (1.20) |
| N52P/N57P | 21008 (0.90) | 27043 (0.08) | 222171 (1.05) | 260 (0.16) | 478 (2.13) |

TABLE E15F-continued

| Additional exemplary variant ICOSL polypeptides | | | | | |
|---|---|---|---|---|---|
| | Binding | | | Costim IFN- | MLR IFN- |
| Mutations | CD28 MFI (ΔWT) | CTLA-4 MFI (ΔWT) | ICOS MFI (ΔWT) | gamma pg/mL (ΔWT) | gamma pg/mL (ΔWT) |
| N52P/N57S/Q100G | 6803 (0.30) | 5054 (0.02) | 143255 (0.68) | 110 (0.07) | 481 (2.14) |
| N52S/N57L/Q100G | 71895 (3.20) | 79432 (0.24) | 275602 (1.30) | 726 (0.44) | 513 (2.28) |
| N52T/N57K/Q100P | 88653 (4.00) | 78299 (0.24) | 312905 (1.48) | 116 (0.07) | 395 (1.76) |
| N52V/N57T/Q100L | 6205 (0.30) | 11458 (0.03) | 29167 (0.14) | 85 (0.05) | 562 (2.50) |
| N57Q/Q100P | 15195 (0.70) | 69058 (0.21) | 204533 (0.97) | 159 (0.10) | 432 (1.92) |
| WT ICOSL | 22340 (1.00) | 330437 (1.00) | 211945 (1.00) | 1648 (1.00) | 225 (1.00) |
| Full length N52H/N57Y/Q100R/F172S | 138141 (6.20) | 605794 (1.83) | 237653 (1.12) | — | 0 (0.00) |
| N52H/N57Y/Q100R | 142274 (6.40) | 817010 (2.47) | 199528 (0.94) | — | 0 (0.00) |
| N52H/N57Y/Q100R | — | — | — | 10362 (6.29) | — |

7 CTLA-1 Binding and Bioactivity Data

Fc-fusion binding studies were performed to assess specificity and affinity of CTLA-4 ECD variant immunomodulatory proteins for binding partners CD80, CD86, and ICOSL. The Fc-fusion variant proteins were further characterized for bioactivity in human primary T cells in vitro assays. Soluble CTLA-4-Fc bioactivity was tested in a human Mixed Lymphocyte Reaction (MLR). Human primary dendritic cells (DC) generated by culturing monocytes isolated from PBMC (BenTech Bio, USA) in vitro for 7 days with 50 ng/mL rIL-4 (R&D Systems, USA) and 80 ng/mL rGM-CSF (R&D Systems, USA) in Ex-Vivo 15 media (Lonza, Switzerland). On days 3 and 5, half of the media was removed and replaced with fresh media containing 50 ng/mL rIL-4 and 80 ng/mL rGM-CSF. To fully induce DC maturation, lipopolysaccharide (LPS) (InvivoGen Corp., USA) was added at 100 ng/mL to the DC cultures on day 6 and cells were incubated for an additional 24 hours. Approximately, 10,000 matured DC and 100,000 purified allogeneic CD3+ T cells (BenTech Bio, USA) were co-cultured with CTLA-4 variant Fc fusion proteins and controls in 96 well round bottom plates in 200 μl final volume of Ex-Vivo 15 media.

TABLE E16A

| Binding and bioactivity of variant CTLA-4-Fc polypeptides | | | | |
|---|---|---|---|---|
| | Binding | | | MLR |
| Mutations | CD80 MFI (Δ WT) | CD86 MFI (Δ WT) | ICOSL MFI (Δ WT) | IFN-Y [pg/mL] (Δ WT) |
| L12P/A26T/ L63P/ L98Q/Y105L | 829 ( 0.2 ) | 761890 ( 1.1 ) | 873 ( 0.5 ) | 216 ( 0.3 ) |
| L12P/A26T | 1024 ( 0.2 ) | 276276 ( 0.4 ) | 928 ( 0.6 ) | 850 ( 1.3 ) |
| L12P/A26T/ L63P | 2400 ( 0.5 ) | 500345 ( 0.7 ) | 891 ( 0.5 ) | 671 ( 1.0 ) |
| L63P/L98Q/ Y105L | 4718 ( 1.0 ) | 410571 ( 0.6 ) | 1802 ( 1.1 ) | 124 ( 0.2 ) |
| L98Q/Y105L | 3863 ( 0.8 ) | 685365 ( 1.0 ) | 1186 ( 0.7 ) | 124 ( 0.2 ) |
| L63P | 3932 ( 0.8 ) | 595807 ( 0.8 ) | 966 ( 0.6 ) | 261 ( 0.4 ) |

TABLE E16A-continued

Binding and bioactivity of variant CTLA-4-Fc polypeptides

| Mutations | Binding | | | MLR |
|---|---|---|---|---|
| | CD80 MFI (Δ WT) | CD86 MFI (Δ WT) | ICOSL MFI (Δ WT) | IFN-γ [pg/mL] (Δ WT) |
| L98R/N110K | 2110 ( 0.4 ) | 665012 ( 0.9 ) | 1046 ( 0.6 ) | 344 ( 0.5 ) |
| WT CTLA-4 | 4775 ( 1.0 ) | 708753 ( 1.0 ) | 1664 ( 1.0 ) | 662 ( 1.0 ) |

TABLE E16B

Binding and bioactivity of variant CTLA-4-Fc polypeptides

| Mutations | Binding | | | MLR |
|---|---|---|---|---|
| | CD80 MFI (Δ WT) | CD86 MFI (Δ WT) | ICOSL MFI (Δ WT) | IFN-γ [pg/mL] (Δ WT) |
| L12P/A26T/L63P/L98Q/M99L/Y105L | 2026 ( 0.4 ) | 33068 ( 0.9 ) | 1222 ( 0.7 ) | 569 ( 1.5 ) |
| E33M/Q82H/L98Q/M99L/Y105L | 1098 ( 0.2 ) | 35506 ( 1.0 ) | 1792 ( 1.1 ) | 253 ( 0.7 ) |
| L63P/S72G/L98Q/M99L/Y105L | 2591 ( 0.5 ) | 33477 ( 0.9 ) | 1604 ( 1.0 ) | 586 ( 1.6 ) |
| S14N/R16C/I18T/M56K/T61A/L63P/A86T/M99L | 3773 ( 0.8 ) | 30572 ( 0.8 ) | 990 ( 0.6 ) | 441 ( 1.2 ) |
| S27P/M56K/L63P/S72G/S73R/T89A/M99L/Y105L/I117M | 1982 ( 0.4 ) | 33467 ( 0.9 ) | 1354 ( 0.8 ) | 426 ( 1.1 ) |
| M56K/L63P/N75D/V96I/M99L/Y105L/L106I | 3775 ( 0.8 ) | 31296 ( 0.9 ) | 1719 ( 1.0 ) | 583 ( 1.6 ) |
| L63P/S72G/Y105L | 3831 ( 0.8 ) | 32160 ( 0.9 ) | 1362 ( 0.8 ) | 123 ( 0.3 ) |
| L63P/L98Q/M99L/Y105L/I117M | 2635 ( 0.6 ) | 32564 ( 0.9 ) | 1761 ( 1.1 ) | 539 ( 1.4 ) |
| L63P/S72G/L98Q/M99L/Y105L/L106I/I117L | 2463 ( 0.5 ) | 32830 ( 0.9 ) | 1930 ( 1.2 ) | 603 ( 1.6 ) |
| A26T/L63P/S72G/L98Q/Y105L/L106I/I117L | 3576 ( 0.7 ) | 31549 ( 0.9 ) | 939 ( 0.6 ) | 83 ( 0.2 ) |
| L63P/L98Q/V116A | 2772 ( 0.6 ) | 32657 ( 0.9 ) | 1033 ( 0.6 ) | 298 ( 0.8 ) |
| G29W/L98Q/M99L/Y105L | 1772 ( 0.4 ) | 32977 ( 0.9 ) | 6183 ( 3.7 ) | 745 ( 2.0 ) |
| T37S/M56V/L98Q/Y105L | 2115 ( 0.4 ) | 27628 ( 0.8 ) | 881 ( 0.5 ) | 148 ( 0.4 ) |
| A26T/Y54F/M56K/M99L/Y105L | 1526 ( 0.3 ) | 28149 ( 0.8 ) | 1113 ( 0.7 ) | 552 ( 1.5 ) |
| L12P/I18T/A26T/M55T/T69S/S72G/M99L/Y105L | 1577 ( 0.3 ) | 25936 ( 0.7 ) | 931 ( 0.6 ) | 944 ( 2.5 ) |
| V22I/L63P/L98Q/Y105L/I117M | 2802 ( 0.6 ) | 27629 ( 0.8 ) | 1013 ( 0.6 ) | 103 ( 0.3 ) |
| A26T/L63P/S72G/L98Q/M99L/Y105L | 2899 ( 0.6 ) | 26407 ( 0.7 ) | 1759 ( 1.1 ) | 195 ( 0.5 ) |
| I18T/T61R/L63P/S72G/L98Q/M99L/P102L/Y105L | 1140 ( 0.2 ) | 46974 ( 1.3 ) | 935 ( 0.6 ) | 714 ( 1.9 ) |
| E33M/A42T/L98Q/Y105L | 1623 ( 0.3 ) | 27354 ( 0.7 ) | 1675 ( 1.0 ) | 638 ( 1.7 ) |
| M55T/E97Q/M99L/Y105F | 906 ( 0.2 ) | 6249 ( 0.2 ) | 1037 ( 0.6 ) | 575 ( 1.5 ) |
| M55T/S72G/L98Q/M99L/Y105L | 1940 ( 0.4 ) | 30594 ( 0.8 ) | 2313 ( 1.4 ) | 594 ( 1.6 ) |
| R16C/G29W/E33V/M55T/L63P/L98Q/Y105L | 2678 ( 0.6 ) | 28858 ( 0.8 ) | 1480 ( 0.9 ) | 144 ( 0.4 ) |
| L12P/A26T/L63P/L98Q/Y105L/L106I | 2318 ( 0.5 ) | 28463 ( 0.8 ) | 879 ( 0.5 ) | 127 ( 0.3 ) |
| M56L/L63P/L98Q/Y105L/L106I/I117L | 3487 ( 0.7 ) | 32054 ( 0.9 ) | 963 ( 0.6 ) | 72 ( 0.2 ) |
| S15P/I18V/M56T/L98Q/M99L/Y105L | 1445 ( 0.3 ) | 33793 ( 0.9 ) | 1505 ( 0.9 ) | 622 ( 1.7 ) |
| I18T/G29W/L63P/L98Q/Y105L | 10109 ( 2.1 ) | 29367 ( 0.8 ) | 1711 ( 1.0 ) | 50 ( 0.1 ) |
| L63P/Q82H/L98Q/M99L/Y105L | 2777 ( 0.6 ) | 31740 ( 0.9 ) | 2110 ( 1.3 ) | 723 ( 1.9 ) |
| L98Q/M99L/Y105L/L106I/I117T | 1117 ( 0.2 ) | 28174 ( 0.8 ) | 1081 ( 0.6 ) | 944 ( 2.5 ) |
| L98Q/M99L/Y105L/L106I/Y115N | 1074 ( 0.2 ) | 27514 ( 0.7 ) | 939 ( 0.6 ) | 322 ( 0.9 ) |

TABLE E16B-continued

Binding and bioactivity of variant CTLA-4-Fc polypeptides

| Mutations | Binding | | | MLR |
|---|---|---|---|---|
| | CD80 MFI (Δ WT) | CD86 MFI (Δ WT) | ICOSL MFI (Δ WT) | IFN-γ [pg/mL] (Δ WT) |
| M55T/L63P/T71I/M99L/Y105L | 2900 ( 0.6 ) | 24010 ( 0.7 ) | 1125 ( 0.7 ) | 384 ( 1.0 ) |
| A26T/T53S/M56K/L63P/L98Q/Y105L | 3352 ( 0.7 ) | 23688 ( 0.6 ) | 1042 ( 0.6 ) | 88 ( 0.2 ) |
| I18T/A26T/L63P/Q82R/L98Q/Y105L | 3650 ( 0.8 ) | 26133 ( 0.7 ) | 923 ( 0.6 ) | 105 ( 0.3 ) |
| L12H/M55T/E59D/L63P/M99L | 2877 ( 0.6 ) | 26206 ( 0.7 ) | 876 ( 0.5 ) | 619 ( 1.7 ) |
| I18T/L63P/S72G/L98Q/Y105L/I108V | 2706 ( 0.6 ) | 26196 ( 0.7 ) | 960 ( 0.6 ) | 62 ( 0.2 ) |
| I18T/L63P/S72G/L98Q/M99L/Y105L | 2442 ( 0.5 ) | 29111 ( 0.8 ) | 2489 ( 1.5 ) | 817 ( 2.2 ) |
| T61A/L63P/S72G/L98Q/M99L/Y105L | 2505 ( 0.5 ) | 32390 ( 0.9 ) | 1987 ( 1.2 ) | 944 ( 2.5 ) |
| V38I/L63P/S72G/L98Q/M99L/Y105L | 3433 ( 0.7 ) | 33373 ( 0.9 ) | 2410 ( 1.4 ) | 846 ( 2.3 ) |
| L63P/S72G/I93L/L98Q/M99L/Y105L | 3282 ( 0.7 ) | 32885 ( 0.9 ) | 2277 ( 1.4 ) | 897 ( 2.4 ) |
| L12I/M55T/M56V/I67T/M99L/L106R/I108F | 2917 ( 0.6 ) | 31744 ( 0.9 ) | 2485 ( 1.5 ) | 842 ( 2.3 ) |
| I18N/A26T/L63H/T89A/L98Q/M99L/Y105L | 1943 ( 0.4 ) | 31558 ( 0.9 ) | 2175 ( 1.3 ) | 689 ( 1.8 ) |
| I18T/E48R/L63P/T69S/L98Q/Y105L/N110Y | 1086 ( 0.2 ) | 23508 ( 0.6 ) | 1124 ( 0.7 ) | 645 ( 1.7 ) |
| I18N/L63P/S72T/M87T/L98Q/Y105L/N110S | 1998 ( 0.4 ) | 36385 ( 1.0 ) | 1032 ( 0.6 ) | 73 ( 0.2 ) |
| G29W/M56T/L63P/L98Q/Y105L/L106I/I117L | 3308 ( 0.7 ) | 32787 ( 0.9 ) | 1258 ( 0.8 ) | 78 ( 0.2 ) |
| G29W/N58S/L63P/M87T/L98Q/M99L/Y105L | 3381 ( 0.7 ) | 32622 ( 0.9 ) | 3622 ( 2.2 ) | 578 ( 1.6 ) |
| G29W/N58S/L63P/D64N/L98Q/M99L/Y105L | 3750 ( 0.8 ) | 33612 ( 0.9 ) | 2158 ( 1.3 ) | 227 ( 0.6 ) |
| I18T/L63P/S72G/M87K/L98Q/M99L/Y105L | 2925 ( 0.6 ) | 35032 ( 1.0 ) | 1999 ( 1.2 ) | 679 ( 1.8 ) |
| WT CTLA4 | 4775 ( 1.0 ) | 36785 ( 1.0 ) | 1664 ( 1.0 ) | 373 ( 1.0 ) |

TABLE E16C

Binding and bioactivity of variant CTLA-4-Fc polypeptides

| Mutations | Binding | | | MLR |
|---|---|---|---|---|
| | CD80 MFI (Δ WT) | CD86 MFI (Δ WT) | ICOSL MFI (Δ WT) | IFN-γ [pg/mL] (Δ WT) |
| M56V | 2688 ( 0.6 ) | 36766 ( 0.1 ) | 822 ( 0.5 ) | 176 ( 1.3 ) |
| L63P/K95R | 2914 ( 0.6 ) | 33412 ( 0.0 ) | 819 ( 0.5 ) | 165 ( 1.2 ) |
| L63P/L98Q | 2830 ( 0.6 ) | 31416 ( 0.0 ) | 885 ( 0.5 ) | 229 ( 1.6 ) |
| L98Q/M99L/Y105L | 1472 ( 0.3 ) | 33977 ( 0.0 ) | 1541 ( 0.9 ) | 325 ( 2.3 ) |
| L63P/M87K/M99L/L106R | 3329 ( 0.7 ) | 61526 ( 0.1 ) | 2540 ( 1.5 ) | 531 ( 3.8 ) |
| L63P/M99L/Y105L/I108F | 2142 ( 0.4 ) | 32781 ( 0.0 ) | 3759 ( 2.3 ) | 1053 ( 7.5 ) |
| V10A/L63P/L98Q/Y105L | 3148 ( 0.7 ) | 34595 ( 0.0 ) | 869 ( 0.5 ) | 141 ( 1.0 ) |
| M56T/L91R/L98Q/Y105L | 1713 ( 0.4 ) | 33645 ( 0.0 ) | 1128 ( 0.7 ) | 0 ( 0.0 ) |
| A26T/L63P/M87V/N110K/I117E | 2909 ( 0.6 ) | 31487 ( 0.0 ) | 973 ( 0.6 ) | 426 ( 3.0 ) |
| G29W/L63P/L98Q/M99L/Y105L | 5165 ( 1.1 ) | 37721 ( 0.1 ) | 3023 ( 1.8 ) | 438 ( 3.1 ) |
| A26T/V46E/L63P/D65G/L98Q | 5009 ( 1.0 ) | 38407 ( 0.1 ) | 888 ( 0.5 ) | 273 ( 1.9 ) |
| G29W/N58S/L63P/L98Q/Y105L | 15619 ( 3.3 ) | 34897 ( 0.0 ) | 1374 ( 0.8 ) | 0 ( 0.0 ) |
| G29W/E59G/L63P/L98Q/Y105L | 3214 ( 0.7 ) | 32786 ( 0.0 ) | 1148 ( 0.7 ) | 0 ( 0.0 ) |

TABLE E16C-continued

Binding and bioactivity of variant CTLA-4-Fc polypeptides

| Mutations | Binding CD80 MFI (Δ WT) | Binding CD86 MFI (Δ WT) | Binding ICOSL MFI (Δ WT) | MLR IFN-γ [pg/mL] (Δ WT) |
|---|---|---|---|---|
| L12H/L63P/S72G/L98Q/Y105L | 2034 ( 0.4 ) | 31843 ( 0.0 ) | 857 ( 0.5 ) | 87 ( 0.6 ) |
| A6T/A26T/M55T/M99L/Y105L | 1429 ( 0.3 ) | 33589 ( 0.0 ) | 938 ( 0.6 ) | 472 ( 3.4 ) |
| A26T/L63P/D65G/L98Q/M99L/Y105L | 2324 ( 0.5 ) | 33672 ( 0.0 ) | 2200 ( 1.3 ) | 264 ( 1.9 ) |
| V10A/L63P/D64V/S72G/L98Q/M99L/Y105L | 2598 ( 0.5 ) | 33868 ( 0.0 ) | 2502 ( 1.5 ) | 904 ( 6.4 ) |
| L12P/G29W/D43N/N58S/L63P/L98Q/M99L/Y105L | 1486 ( 0.3 ) | 30004 ( 0.0 ) | 1276 ( 0.8 ) | 352 ( 2.5 ) |
| I18V/A26T/L63P/D64E/L98Q/Y105L/L106R/N110K | 4096 ( 0.9 ) | 30852 ( 0.0 ) | 17220 ( 10.3 ) | 0 ( 0.0 ) |
| A19V/G29W/R35K/L63P/L98Q/M99L/Y105L | 2349 ( 0.5 ) | 33255 ( 0.0 ) | 3119 ( 1.9 ) | 445 ( 3.2 ) |
| L12P/A26T/L63P/S72G/T89M/L98Q/M99L/Y105L | 1833 ( 0.4 ) | 924222 ( 1.3 ) | 919 ( 0.6 ) | 536 ( 3.8 ) |
| P28L/E33V/L63P/S72G/L98R/M99L/Y105L | 1441 ( 0.3 ) | 782025 ( 1.1 ) | 966 ( 0.6 ) | 535 ( 3.8 ) |
| E24Q/L63P/S72G/L98Q/M99L/Y105L | 2864 ( 0.6 ) | 729343 ( 1.0 ) | 1080 ( 0.6 ) | 867( 6.2 ) |
| I18T/G29R/L63P/S72G/L98Q/M99L/Y105L | 3592 ( 0.8 ) | 857127 ( 1.2 ) | 1014 ( 0.6 ) | 366 ( 2.6 ) |
| L63P/L98Q/M99L/Y105L | 2662 ( 0.6 ) | 618249 ( 0.9 ) | 868 ( 0.5 ) | 944 ( 6.7 ) |
| Q41L/Y54F/M56K/M99L/I108F | 2570 ( 0.5 ) | 703731 ( 1.0 ) | 940 ( 0.6 ) | 408 ( 2.9 ) |
| S72G/L98Q/M99L/Y105L/I117T | 1374 ( 0.3 ) | 863538 ( 1.2 ) | 968 ( 0.6 ) | 221 ( 1.6 ) |
| M56R/L63P/L98Q/M99L/Y105L | 2546 ( 0.5 ) | 911035 ( 1.3 ) | 839 ( 0.5 ) | 1198 ( 8.5 ) |
| E33M/L63P/S72G/L98Q/Y105L | 1532 ( 0.3 ) | 518203 ( 0.7 ) | 999 ( 0.6 ) | 1220 ( 8.7 ) |
| L63P/L98Q/M99L/Y105L/L106I | 2814 ( 0.6 ) | 1007606 ( 1.4 ) | 1004 ( 0.6 ) | 773 ( 5.5 ) |
| A26T/M55R/L98Q/M99L/Y105L | 2324 ( 0.5 ) | 520232 ( 0.7 ) | 986 ( 0.6 ) | 468 ( 3.3 ) |
| L63P/S72G/M87A/L98Q/Y105L | 2769 ( 0.6 ) | 349875 ( 0.5 ) | 875 ( 0.5 ) | 202 ( 1.4 ) |
| A26D/S72G/L98Q/M99L/Y105L | 5409 ( 1.1 ) | 578704 ( 0.8 ) | 1235 ( 0.7 ) | 1097 ( 7.8 ) |
| V22A/L63P/L98Q/M99L/Y105L/P119H | 2820 ( 0.6 ) | 642849 ( 0.9 ) | 992 ( 0.6 ) | 1174 ( 8.4 ) |
| A26T/M55T/L63P/L98Q/M99L/Y105L | 3203 ( 0.7 ) | 850654 ( 1.2 ) | 875 ( 0.5 ) | 1096 ( 7.8 ) |
| E33V/A42S/M55T/L98Q/M99L/Y105L | 2195 ( 0.5 ) | 929792 ( 1.3 ) | 1043 ( 0.6 ) | 1478 ( 10.5 ) |
| G29W/N58S/L63P/Q82R/L98Q/Y105L | 18277 ( 3.8 ) | 950639 ( 1.3 ) | 1463 ( 0.9 ) | 0 ( 0.0 ) |
| E33M/L63P/S72G/L98Q/Y105L/I117L | 2293 ( 0.5 ) | 912480 ( 1.3 ) | 907 ( 0.5 ) | 586 ( 4.2 ) |
| A26T/I67N/S72G/L98Q/M99L/Y105L | 1740 ( 0.4 ) | 976150 ( 1.4 ) | 948 ( 0.6 ) | 1331 ( 9.5 ) |
| L12F/A26T/L63P/L98Q/Y105L/L106R | 2186 ( 0.5 ) | 984573 ( 1.4 ) | 867 ( 0.5 ) | 1286 ( 9.2 ) |
| S20N/A26T/L63P/L98Q/M99L/Y105L | 3707 ( 0.8 ) | 941466 ( 1.3 ) | 1020 ( 0.6 ) | 1879 ( 13.4 ) |
| G29W/T61I/L63P/S72G/L98Q/M99L/Y105L | 3446 ( 0.7 ) | 842791 ( 1.2 ) | 1024 ( 0.6 ) | 718 ( 5.1 ) |
| G29W/N58S/L63P/T69I/L98Q/M99L/Y105L | 4558 ( 1.0 ) | 841939 ( 1.2 ) | 1945 ( 1.2 ) | 1036 ( 7.4 ) |

TABLE E16C-continued

Binding and bioactivity of variant CTLA-4-Fc polypeptides

| Mutations | Binding CD80 MFI (Δ WT) | Binding CD86 MFI (Δ WT) | Binding ICOSL MFI (Δ WT) | MLR IFN-γ [pg/mL] (Δ WT) |
|---|---|---|---|---|
| L12P/L63P/S72G/L98Q/M99L/Y105L/L106N | 2991 ( 0.6 ) | 854863 ( 1.2 ) | 894 ( 0.5 ) | 0 ( 0.0 ) |
| L63P/T69 A/L98Q/M99L/Y105L/L106R/V116 A | 3984 ( 0.8 ) | 831276 ( 1.2 ) | 1765 ( 1.1 ) | 0 ( 0.0 ) |
| G29W/N58S/L63P/S72G/L98Q/Y105L | 4262 ( 0.9 ) | 860194 ( 1.2 ) | 1445 ( 0.9 ) | 0 ( 0.0 ) |
| G29W/L63P/D65G/S72G/L98Q/Y105L | 3399 ( 0.7 ) | 854339 ( 1.2 ) | 954 ( 0.6 ) | 0 ( 0.0 ) |
| T53S/M56V/L98Q/Y105L | 3860 ( 0.8 ) | 875378 ( 1.2 ) | 1376 ( 0.8 ) | 0 ( 0.0 ) |
| L63P/S72G/L98Q/Y105L | 3451 ( 0.7 ) | 892268 ( 1.3 ) | 1486 ( 0.9 ) | 0 ( 0.0 ) |
| I18A/L63P/S72G/L98Q/Y105L | 3542 ( 0.7 ) | 637802 ( 0.9 ) | 1240 ( 0.7 ) | 0 ( 0.0 ) |
| G29W/T53S/M56K/L63P/L98Q/Y105L | 3347 ( 0.7 ) | 794165 ( 1.1 ) | 1914 ( 1.2 ) | 179 ( 1.3 ) |
| I18V/G29W/L63P/S72G/L98Q/Y105L | 4064 ( 0.9 ) | 797318 ( 1.1 ) | 1351 ( 0.8 ) | 0 ( 0.0 ) |
| G29W/L63P/S72G/L98Q/Y105L/L106I | 4303 ( 0.9 ) | 829524 ( 1.2 ) | 1474 ( 0.9 ) | 0 ( 0.0 ) |
| G29W/L63P/I67V/S72G/L98Q/Y105L | 3993 ( 0.8 ) | 769557 ( 1.1 ) | 1053 ( 0.6 ) | 0 ( 0.0 ) |
| G29W/M55V/E59G/L63P/L98Q/Y105L | 4174 ( 0.9 ) | 427427 ( 0.6 ) | 1248 ( 0.7 ) | 0 ( 0.0 ) |
| G29W/L63P/S72G/L98Q/Y105L/I117L | 3794 ( 0.8 ) | 502885 ( 0.7 ) | 1853 ( 1.1 ) | 0 ( 0.0 ) |
| L63P/S72G/L98Q/Y105L/L106I/I117L | 3811 ( 0.8 ) | 789352 ( 1.1 ) | 1885 ( 1.1 ) | 37( 0.3 ) |
| L12F/R16H/G29W/M56T/L98Q/Y105L | 6575 ( 1.4 ) | 919746 ( 1.3 ) | 2615 ( 1.6 ) | 0 ( 0.0 ) |
| L12P/G29W/L63P/S72G/L98Q/Y105L | 4012 ( 0.8 ) | 783049 ( 1.1 ) | 1001 ( 0.6 ) | 155 ( 1.1 ) |
| L12P/G29W/L63P/S72G/L98Q/Y105L/L106I | 4347 ( 0.9 ) | 662327 ( 0.9 ) | 1219 ( 0.7 ) | 195 ( 1.4 ) |
| G29W/L63P/S72G/L98Q/Y105L/L106I/I117L | 3242 ( 0.7 ) | 702231 ( 1.0 ) | 1205 ( 0.7 ) | 133 ( 0.9 ) |
| A26T/T53S/L63P/L98Q/Y105L/L106I/I117L | 4853 ( 1.0 ) | 713974 ( 1.0 ) | 2111 ( 1.3 ) | 0 ( 0.0 ) |
| G29W/N58S/L63P/S72G/M87V/L98Q/Y105L | 4044 ( 0.8 ) | 818528 ( 1.2 ) | 1572 ( 0.9 ) | 0 ( 0.0 ) |
| G29W/S72G/Q76R/L98Q/Y105L/L106I/Q113H | 2421 ( 0.5 ) | 842313 ( 1.2 ) | 2147 ( 1.3 ) | 1129 ( 8.1 ) |
| G29W/N58S/L63P/S72G/L98Q/Y105L/L106V | 1233 ( 0.3 ) | 931184 ( 1.3 ) | 1045 ( 0.6 ) | 844 ( 6.0 ) |
| A26T/L63P/L98Q/M99L/Y105L | 3095 ( 0.6 ) | 762915 ( 1.1 ) | 1863 ( 1.1 ) | 1059 ( 7.6 ) |
| G29W/N58D/I67V/L98Q/M99L/Y105L | 2460 ( 0.5 ) | 898877 ( 1.3 ) | 4222 ( 2.5 ) | 373 ( 2.7 ) |
| 167V/S72G/Q82H/T89A/L98Q/M99L/Y105L | 1729 ( 0.4 ) | 865295 ( 1.2 ) | 5692 ( 3.4 ) | 786 ( 5.6 ) |
| S72G/R85G/L98Q/M99L/Y105L/L106I | 1439 ( 0.3 ) | 905813 ( 1.3 ) | 4653 ( 2.8 ) | 915 ( 6.5 ) |
| L63P/L98Q/M99L/Y105L | 2787 ( 0.6 ) | 824331 ( 1.2 ) | 1723 ( 1.0 ) | 692 ( 4.9 ) |
| A26T/T47A/M56K/L63P/S72G/Q82R/L98Q/M99L/Y105L | 2432 ( 0.5 ) | 835548 ( 1.2 ) | 2767 ( 1.7 ) | 404 ( 2.9 ) |

TABLE E16C-continued

| Binding and bioactivity of variant CTLA-4-Fc polypeptides | | | | |
|---|---|---|---|---|
| | Binding | | | MLR |
| Mutations | CD80 MFI (Δ WT) | CD86 MFI (Δ WT) | ICOSL MFI (Δ WT) | IFN-γ [pg/mL] (Δ WT) |
| A26T/M55T/L63P/S72G/L98Q/M99L/Y105L | 3226 ( 0.7 ) | 1085961 ( 1.5 ) | 2090 ( 1.3 ) | 1413 ( 10.1 ) |
| L12H/I18V/A42T/M55T/N58D/L98R/Y105L/L106I/P121S | 1764 ( 0.4 ) | 896733 ( 1.3 ) | 733 ( 0.4 ) | 170 ( 1.2 ) |
| I18T/A26T/L63P/S72G/L98Q/Y105L | 3265 ( 0.7 ) | 769820 ( 1.1 ) | 802 ( 0.5 ) | 145 ( 1.0 ) |
| LI2F/K30R/S72G/Q82R/L98Q/M99L/Y105L | 1208 ( 0.3 ) | 766257 ( 1.1 ) | 1747 ( 1.0 ) | 718 ( 5.1 ) |
| L12P/L63P/S72G/L98Q/M99L/Y105L/L106N/I117L | 987 ( 0.2 ) | 782940 ( 1.1 ) | 998 ( 0.6 ) | 623 ( 4.4 ) |
| G29W/M87K/I93V/L98Q/M99L/Y105L | 2019 ( 0.4 ) | 767081 ( 1.1 ) | 7975 ( 4.8 ) | 786 ( 5.6 ) |
| P28L/E33V/L63P/S72G/L98Q/M99L/Y105L | 1163 ( 0.2 ) | 798068 ( 1.1 ) | 1849 ( 1.1 ) | 1161 ( 8.3 ) |
| G29W/T53S/M56K/L63P/Q82H/L98Q/M99I/Y105L | 4087 ( 0.9 ) | 425068 ( 0.6 ) | 5654 ( 3.4 ) | 956 ( 6.8 ) |
| I18F/L63P/L98Q/M99L/Y105L/P121S | 2392 ( 0.5 ) | 486401 ( 0.7 ) | 1765 ( 1.1 ) | 737 ( 5.3 ) |
| L63P/L98Q/M99L/Y105L/I108V | 3455 ( 0.7 ) | 730161 ( 1.0 ) | 2074 ( 1.2 ) | 592 ( 4.2 ) |
| A26T/A42V/Q45H/I67N/M87K/E97Q/M99L | 10573 ( 2.2 ) | 610530 ( 0.9 ) | 24030 ( 14.4 ) | 1282 ( 9.1 ) |
| E33M/L63P/S72G/L98Q/Y105L | 1984 ( 0.4 ) | 933740 ( 1.3 ) | 2401 ( 1.4 ) | 1849 ( 13.2 ) |
| M56V/E59G/L63P/S72G/M87K/I93V/L98Q/M99L/Y105L/I117E | 1940 ( 0.4 ) | 758136 ( 1.1 ) | 1552 ( 0.9 ) | 332 ( 2.4 ) |
| G29W/M87K/T89S/L98Q/M99L/Y105L/I108V/I117L | 3525 ( 0.7 ) | 913043 ( 1.3 ) | 9533 ( 5.7 ) | 232 ( 1.7 ) |
| L12P/M56V/L63P/V96I/L98Q/M99L/Y105L/Y115H | 1647 ( 0.3 ) | 891092 ( 1.3 ) | 1059 ( 0.6 ) | 907 ( 6.5 ) |
| G29W/T53S/M56K/T61N/L63P/L98Q/Y105L | 3375 ( 0.7 ) | 919607 ( 1.3 ) | 1454 ( 0.9 ) | 0 ( 0.0 ) |
| H8T/A26S/M55T/M56V/L63P/S72G/L98Q/M99L/Y105L/I117K | 2455 ( 0.5 ) | 782684 ( 1.1 ) | 1686 ( 1.0 ) | 530 ( 3.8 ) |
| I18T/T61R/L63P/S72G/L98Q/M99L/Y105L | 3315 ( 0.7 ) | 926617 ( 1.3 ) | 2390 ( 1.4 ) | 296 ( 2.1 ) |
| L12P/L63P/S72G/L98Q/M99L/Y105L | 1784 ( 0.4 ) | 1045369 ( 1.5 ) | 1510 ( 0.9 ) | 968 ( 6.9 ) |
| E33M/L63P/S72G/L98Q/Y105L/I08F | 1481 ( 0.3 ) | 820016 ( 1.2 ) | 2109 ( 1.3 ) | 766 ( 5.5 ) |
| L12P/R16H/A26T/T61S/L63P/M87V/L98Q/M99L/Y105L/L106I/I17L | 1926 ( 0.4 ) | 895016 ( 1.3 ) | 1046 ( 0.6 ) | 593 ( 4.2 ) |
| G29W/T53S/M56K/N58S/L63P/M87V/L98Q/Y105L/P121S | 7819 ( 1.6 ) | 778254 ( 1.1 ) | 2249 ( 1.4 ) | 0 ( 0.0 ) |

TABLE E16C-continued

| Binding and bioactivity of variant CTLA-4-Fc polypeptides | | | | |
|---|---|---|---|---|
| | Binding | | | MLR |
| Mutations | CD80 MFI (Δ WT) | CD86 MFI (Δ WT) | ICOSL MFI (Δ WT) | IFN-γ [pg/mL] (Δ WT) |
| G29W/L63P/S72G/L98Q/Y105L/P121S | 3395 ( 0.7 ) | 763120 ( 1.1 ) | 1559 ( 0.9 ) | 0 ( 0.0 ) |
| G29W/T53S/M56K/N58S/L63P/M87V/L98Q/Y105L | 8116 ( 1.7 ) | 257214 ( 0.4 ) | 2517 ( 1.5 ) | 0 ( 0.0 ) |
| G29W/T53S/M56K/N58S/L63P/M87V/L98Q/Y105L/I108V | 7775 ( 1.6 ) | 271930 ( 0.4 ) | 3703 ( 2.2 ) | 45 ( 0.3 ) |
| G29W/T53S/L63P/S72G/L98Q/Y105L | 4497 ( 0.9 ) | 174601 ( 0.2 ) | 1545 ( 0.9 ) | 0 ( 0.0 ) |
| V10A/G29 W/T53S/M56K/L63P/L98Q/Y105L/P121S | 6058 ( 1.3 ) | 766570 ( 1.1 ) | 1612 ( 1.0 ) | 0 ( 0.0 ) |
| WT CTLA-4 | 4775 ( 1.0 ) | 708753 ( 1.0 ) | 1664 ( 1.0 ) | 140 ( 1.0 ) |

a. CTLA-4 Consensus Variants

Additional variants of CTLA-4 ECD were designed by identifying consensus residues identified in the screen described in Examples 8-12 and this Example above that were commonly associated with CTLA-4 that variants that exhibited improved CD80, CD86, and/or ICOSL binding and/or demonstrated suppression of interferon-gamma secretion in the MLR assay. The selected consensus mutations included I18T, A26T, E33V, T53S, M55T, M56K, N58S, L63P, M87V, L98Q, M99L, and Y105L. The consensus mutants were used to generate variant CTLA-4 ECDs by site-directed mutagenesis with reference to the wild-type sequence set forth in SEQ ID NO: 36, which was then formatted as an Fc fusion protein as described in Example 11. The variant CTLA-4 ECD-Fc fusions were tested for binding and bioactivity as described below.

1. Binding and Bioactivity

To produce cells expressing cognate binding partners, full-length mammalian surface expression constructs for each of human CD80, CD86, and ICOSL were designed in pcDNA3.1 expression vector (Life Technologies) and sourced from Genscript, USA. Binding studies were carried out using the Expi293F transient transfection system (Life Technologies, USA) described above. The number of cells needed for the experiment was determined, and the appropriate 30 mL scale of transfection was performed using the manufacturer's suggested protocol. For each counter structure or mock 30 mL transfection, 75 million Expi293F cells were incubated with 30 μg expression construct DNA and 1.5 mL diluted ExpiFectamine™ 293 reagent for 48 hours, at which point cells were harvested for staining.

In some instances, cells with stable expression of cognate binding partners were used. Chinese hamster ovarian cells (CHO) were stably transduced by lentivirus for surface expression of full-length human CD80, CD86, or ICOSL.

For flow cytometric analysis, 200,000 cells of a given transient transfection, stable cell line, or appropriate negative control were plated in 96 well round bottom plates. Cells were spun down and suspended in staining buffer (PBS (phosphate buffered saline), 1% BSA (bovine serum albumin), and 0.1% sodium azide) for 20 minutes to block non-specific binding. Afterwards, cells were centrifuged again and suspended in staining buffer containing 100 nM to 100 pM CTLA-4 variant Fc fusion protein or control in 50 μL. Primary staining was performed for 45 minutes, before washing cells in staining buffer twice. Bound CTLA-4 was detected with PE-conjugated anti-human IgG (Jackson ImmunoResearch, USA) diluted 1:150 in 50 μL staining buffer and incubated for 30 minutes. Alternatively, bound CTLA-4 was detected with anti-CTLA-4 antibody (Biolegend, USA) diluted 1:130 in 50 μL staining buffer for 30 minutes, before washing cells in staining buffer twice. Anti-CTLA-4 antibody was then detected with PE-conjugated anti-mouse IgG (Jackson ImmunoResearch, USA) diluted 1:150 in 50 μL staining buffer and incubated for 30 minutes.

After final incubation, cells were washed twice to remove unbound conjugated antibodies, fixed in 2% formaldehyde/PBS, and analyzed on a Hypercyt (Intellicyte, USA) or LSRII (Becton Dickinson, USA) flow cytometer.

Mean Fluorescence Intensity (MFI) was calculated for each sample with Cell Quest Pro software (Becton Dickinson, USA), FlowJo software (FlowJo, USA), or Forcyte software (Intellicyt, USA).

2. CD86 Blockade Bioassay

Select CTLA-4 variant Fc fusion proteins were assayed for capacity to block CD86-CD28 mediated costimulation as determined by a CD86 blockade bioassay. Artificial antigen presenting cells (APCs) were generated by transducing K562 cells with lentivirus to express cell surface anti-human CD3 single chain Fv (OKT3) and human CD86, yielding K562/OKT3/CD86. Effector cells were generated by transducing Jurkat cells expressing an IL-2-luciferace reporter (Promega) with lentivirus to express a chimeric receptor composed of the extracellular domain of human ICOS and the intracellular domain of human CD28, yielding Jurkat/IL-2/ICOS-CD28. APCs were plated in 33 μL/well of assay buffer (RPMI1640 with 5% FBS) at $2\times10^4$ cells/well with CTLA-4-Fc or control proteins in 33 μL/well at 300 nM. APCs and proteins were incubated for 20 minutes at room temperature before the addition of effector cells at $2\times10^5$ cell/well in 33 μL/well. The plates were transferred to a 37 degrees Celsius, humidified with 5% CO2 in an incubation chamber for 5 hours, then removed and allowed to acclimate to room temperature for 15 minutes. 100 μL/well of cell lysis and luciferase substrate solution (BioGlo™ luciferase reagent, Promega) was added to each plate and incubated on an orbital shaker for 10 minutes. Relative luminescence values (RLU) were determined for each test sample by measuring luminescence with a 1 second per well integration time using a Cytation 3 imaging reader (BioTek instruments). The percent inhibition mediated by CD86 blockade was determined using the following formula: [(Avg. Control RLU−Experimental RLU)/(Avg. Control RLU)]×100.

The results are summarized below in Table E16D. The values for binding CD80, CD86, and ICOSL (MFI) and percent inhibition CD28 costimulation are provided in addition to the relative ratio, as compared to the corresponding binding and CD86 blockade of the unmodified CTLA-4 polypeptide (ΔWT) for each experiment. As indicated, certain mutations and combinations of mutations were associated with a substantial increase in binding of CTLA-4 ECD to ICOSL, independent of the change in binding to either CD80 or CD86. In some cases, increases in binding to one or both of CD80 or CD86 also were observed.

TABLE E16D

Binding and bioactivity of consensus variant CTLA-4-Fc polypeptides

| | Binding | | | CD86 |
|---|---|---|---|---|
| Mutations | CD80 MFI (Δ WT) | CD86 MFI (Δ WT) | ICOSL MFI (Δ WT) | Blockade Bioassay (Δ WT) |
| T53S, M56K, N58S, L63P, M87V, L98Q, Y105L | 631192 (1.2) | 497901 (0.9) | 215054 (50.9) | 88.2 (1.3) |
| I18T, A26T, M55T, M56K, L63P, L98Q, M99L, Y105L | 759480 (1.4) | 657099 (1.1) | 89672 (21.2) | 40.2 (0.6) |
| I18T, A26T, M56K, L63P, L98Q, Y105L | 496119 (0.9) | 601631 (1.0) | 295395 (69.9) | 86.1 (1.2) |
| T53S, L63P, L98Q | 564111 (1.1) | 571155 (1.0) | 11541 (2.7) | 86.2 (1.2) |
| T53S, L63P, Y105L | 526605 (1.0) | 568901 (1.0) | 20739 (4.9) | 86.4 (1.2) |
| T53S, M56K, N58S, L63P, M87V, Y105L | 610377 (1.2) | 604604 (1.0) | 48034 (11.4) | 86.7 (1.3) |
| L98Q, M99L, Y105L | 875290 (1.7) | 686788 (1.2) | 116699 (27.6) | 33.9 (0.5) |
| E33V, L98Q, Y105L | 811261 (1.5) | 580048 (1.0) | 101877 (24.1) | 32.5 (0.5) |
| E33V, M99L | 758165 (1.4) | 618183 (1.1) | 71903 (17.0) | 85.2 (1.2) |
| T53S, M56K, N58S, L63P, M87V, L98Q | 347188 (0.7) | 555921 (1.0) | 7241 (1.7) | 82.6 (1.2) |
| T53S, M56K, N58S, L63P, L98Q, Y105L | 795550 (1.5) | 557059 (1.0) | 248668 (58.8) | 87.4 (1.3) |
| T53S, M56K, N58S, M87V, L98Q, Y105L | 1133587 (2.1) | 676071 (1.2) | 35087 (8.3) | 88.7 (1.3) |
| T53S, M56K, L63P, M87V, L98Q, Y105L | 736640 (1.4) | 546545 (0.9) | 234716 (55.5) | 90.1 (1.3) |
| T53S, N58S, L63P, M87V, L98Q, Y105L | 637509 (1.2) | 508878 (0.9) | 108784 (25.7) | 86.8 (1.3) |
| M56K, N58S, L63P, M87V, L98Q, Y105L | 688049 (1.3) | 574298 (1.0) | 258574 (61.2) | 85.9 (1.2) |
| E33V, L98Q, M99L, | 975697 (1.8) | 628740 (1.1) | 137713 (32.6) | 14.1 (0.2) |
| Wild-type | 529140 (1.0) | 579615 (1.0) | 4228 (1.0) | 69.1 (1.0) |

b. Select CTLA-4 Variants

A further panel of CTLA-4 ECD variants was designed with mutations from a variant CTLA-4 identified in the screen described in Examples 8-12 and this Example above, specifically the variant set forth in SEQ ID NO: 3060 containing mutations L12F/R16H/G29W/M56T/L98Q/Y105L, which was associated with enhanced binding to CD80, CD86, and ICOSL and suppression of interferon-gamma. In some cases, S72G was included because it had been identified as a hot spot that had occurred in greater than 35% of the other top 50 hits that were identified as having suppressive activity. For some generated variants, the strategy included removal of some mutations (reversion mutations), for example, to reduce the number of mutations in the variant. Variant CTLA-4 ECDs were generated by site-directed mutagenesis with reference to the wild-type sequence set forth in SEQ ID NO: 36, which was then formatted as an Fc fusion protein as described in Example 11. The variant CTLA-4 ECD-Fc fusions were tested for binding and bioactivity as described above in this Example.

Table E16E provides the values for binding CD80, CD86, and ICOSL (MFI) and percent inhibition CD28 costimulation in addition to the relative ratio, as compared to the corresponding binding and CD86 blockade of the unmodified CTLA-4 polypeptide (ΔWT) for each experiment.

TABLE E16E

Binding and bioactivity of reversion variant CTLA-4-Fc polypeptides

| Mutations | Binding CD80 MFI (Δ WT) | Binding CD86 MFI (Δ WT) | Binding ICOSL MFI (Δ WT) | MLR CD86 Blockade Bioassay (Δ WT) |
|---|---|---|---|---|
| L12F, R16H, G29W, M56T, L98Q | 76155 (1.5) | 86548 (1.2) | 959 (0.8) | 72.3 (0.9) |
| L12F, R16H, G29W, M56T, Y105L | 73996 (1.4) | 72293 (1.0) | 1944 (1.7) | 77.8 (1.0) |
| L12F, R16H, G29W, L98Q, Y105L | 60527 (1.2) | 78181 (1.1) | 862 (0.7) | 89.0 (1.1) |
| L12F, R16H, M56T, L98Q, Y105L | 70120 (1.4) | 70437 (1.0) | 1265 (1.1) | 86.8 (1.1) |
| G29W, M56T, L98Q, Y105L | 70579 (1.4) | 65251 (0.9) | 612 (0.5) | 88.6 (1.1) |
| L12F, G29W, L98Q, Y105L | 66677 (1.3) | 85018 (1.2) | 807 (0.7) | 90.0 (1.1) |
| L12F, L98Q, Y105L | 67142 (1.3) | 85125 (1.2) | 2584 (2.2) | 86.9 (1.1) |
| R16H, L98Q, Y105L | 67259 (1.3) | 70269 (1.0) | 1018 (0.9) | 89.8 (1.1) |
| G29W, L98Q, Y105L | 90170 (1.8) | 64097 (0.9) | 570 (0.5) | 90.0 (1.1) |
| M56T, L98Q, Y105L | 68644 (1.3) | 70222 (1.0) | 700 (0.6) | 88.0 (1.1) |
| L12F, R16H, G29W, M56T, S72G, L98Q, Y105L | 46175 (0.9) | 58464 (0.8) | 613 (0.5) | 88.3 (1.1) |
| G29W, M56T, S72G, L98Q, Y105L | 55706 (1.1) | 67962 (0.9) | 534 (0.5) | 88.6 (1.1) |
| Wild-type | 51269 (1.0) | 73502 (1.0) | 1160 (1.0) | 80.5 (1.0) |

Example 14

Assessment of PD-1/CD28 Colocalization Induced by Cis and Trans Multi-Domain Immunomodulatory Proteins This Example describes studies to demonstrate the ability of exemplary multi-domain immunomodulatory proteins to colocalize CD28 and PD-1 using PathHunter® U2OS CD28/PD-1 cells (DiscoverX, USA).

U2OS CD28/PD-1 cells contain two inactive fragments of β-galactosidase (β-gal), an enzyme donor (ED) and enzyme acceptor (EA) attached to CD28 and PD-1. Colocalization of CD28 and PD-1 drives complementation between ED and EA protein fragments, creating an active β-gal enzyme that cleaves a substrate to generate chemiluminescent signal.

For the assay, adherent U2OS CD28/PD-1 cells were harvested from the flask, washed and pelleted. Cells were suspended and plated at 20,000 cells in 50 μl/well of a white, flat-bottomed 96 well plate. The cells were allowed to adhere for 4 hours in a 37 degree Celsius, 5% CO2 incubator. Exemplary multi-domain immunomodulatory proteins or control proteins were titrated and added to the adherent cells in 50 μl/well for a final concentration of 10,000-0.01 pM. The plates were returned the incubator for 18 hours. PathHunter Flash Detection (DiscoverX, Catalog 93-0247) was added at 55 μl/well and incubated for 1 hour in the dark. Relative luminescence values (RLU) were determined for each test sample by measuring luminescence with a one second per well integration time.

Figure 19A:
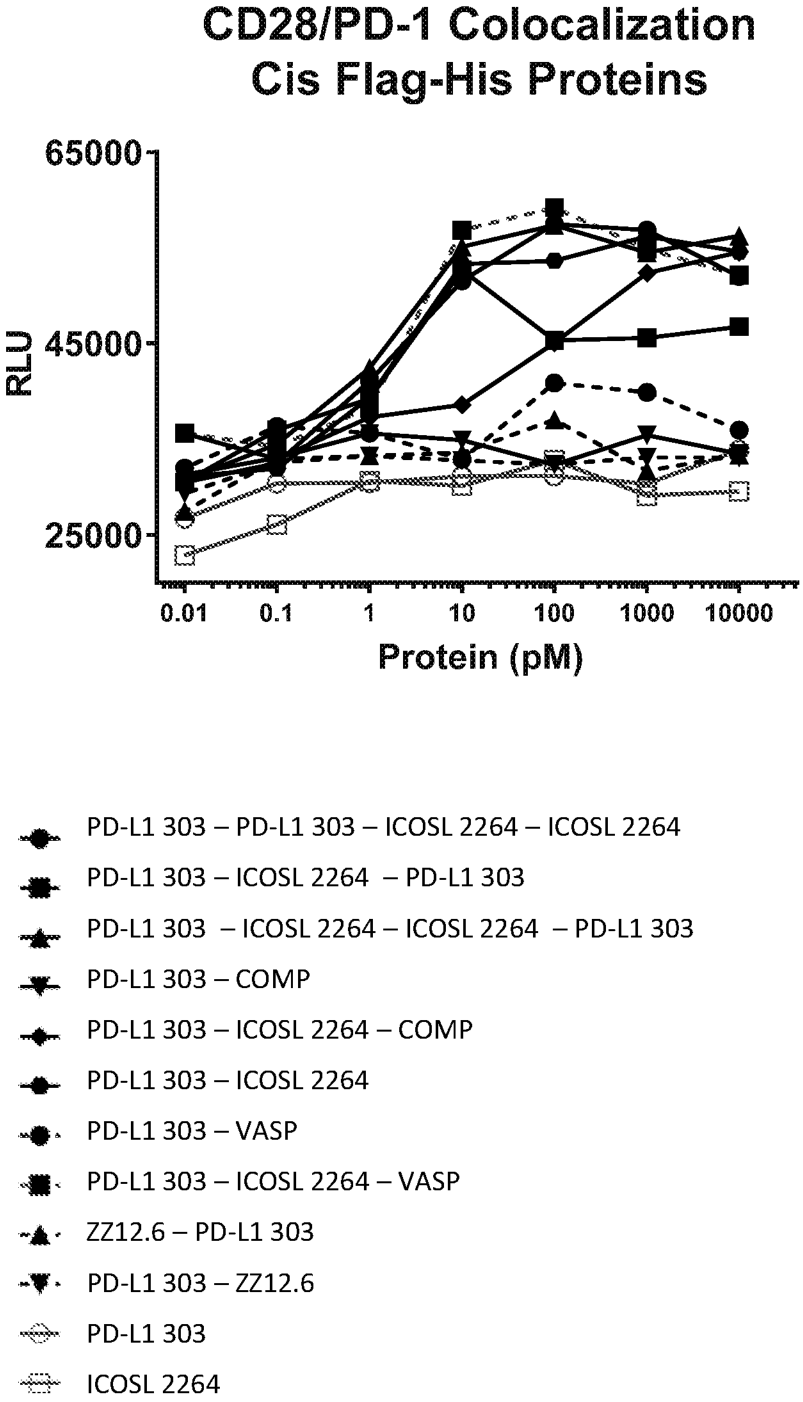
FIG. 19A-19B shows results from an assay using a beta-Galactosidase (beta-Gal) Enzyme Fragment Complementation system to assess the effect of immunomodulatory proteins on colocalization of CD28 and PD-1.
Figure 19B:
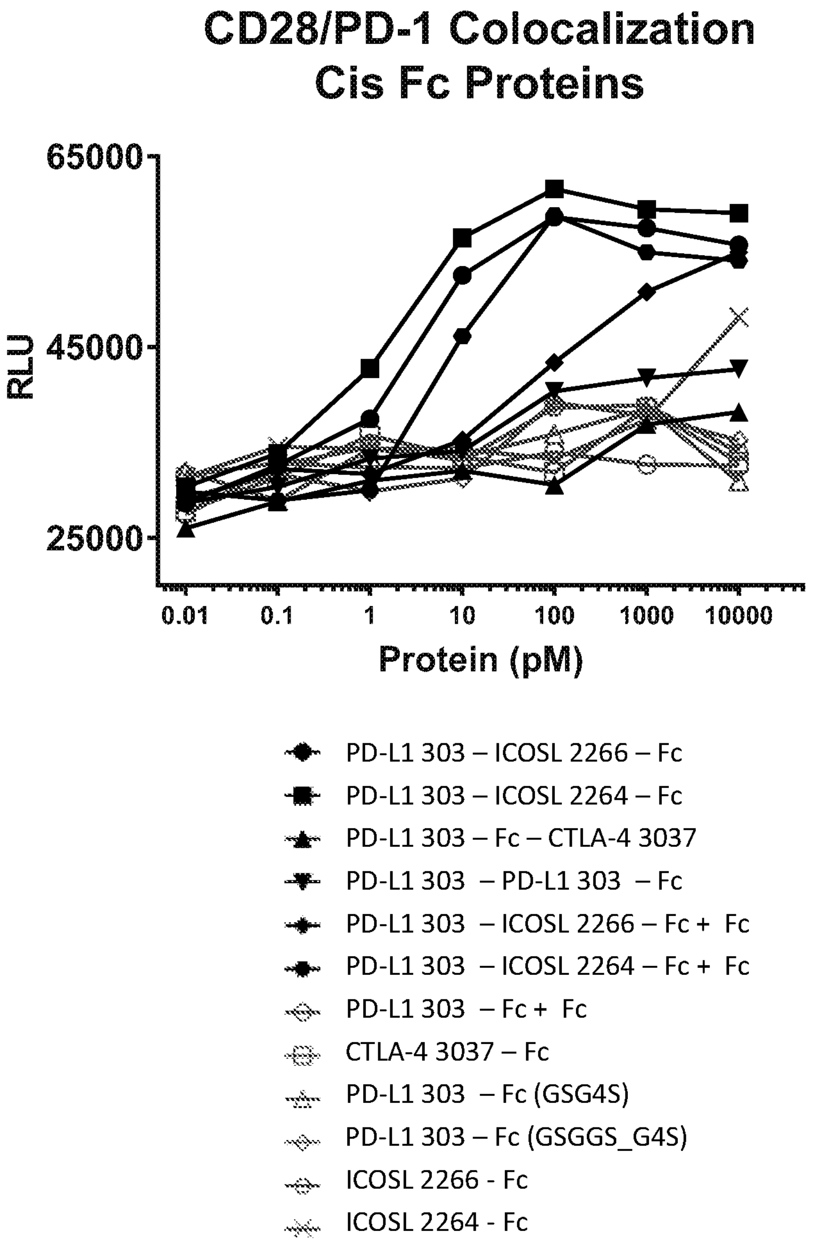

As shown in FIGS. 19A and 19B, colocalization of CD28 and PD-1 was observed in the presence of the tested multi-domain immunomodulatory proteins.

Example 15

Assessment of Treg and FOXP3 Induction by Cis and Trans Multi-Domain Immunomodulatory Proteins This Example describes bioactivity of exemplary multi-domain immunomodulatory proteins in human primary T cells to promote the generation of induced regulatory T-cells (iTregs).

Artificial antigen presenting cells (APC) were generated through lentiviral transduction of K562 cells to express cell surface anti-human CD3 single chain Fv (OKT3) and human CD80. Primary human naïve CD4+ T cells were isolated from peripheral blood mononuclear cells and labeled with 0.25 uM carboxyfluorescein succinimidyl ester (CFSE).

APCs were pulsed with 50 μg/ml mitomycin C for 30 minutes at 37 degree Celsius. Cells were washed 3 times prior to use. 20,000 APCs and 50,000 naïve CD4+ T cells were added to wells of a 96 well round-bottom plate with 2 ng/mL recombinant TGF-β1 and the multi-domain immunomodulatory proteins or control proteins at a final concentration of 100, 33, or 11 nM. Cultures were placed in a 37 degree Celsius, 5% CO2 incubator for one week.

iTreg generation was determined by flow cytometric analysis of the percentage and total number of accumulated $CD25^{+}FoxP3^{+}$ cells after 7 days. For staining, the cells were washed with 170 μL/well DPBS, pelleted and suspended in 100 μL/well Live Dead Near IR stain (Invitrogen, USA) diluted 1:500 in DPBS. Cells were pelleted and stained with 50 μL/well of 1 ug/mL anti-human CD4-BV711 (clone RPA-T4) and CD25-BV421 (clone BC96) (BioLegend, USA) diluted in FACS buffer (PBS 0.5% BSA 0.5 mM EDTA 0.005% NaN3). After a 45 minute incubation, cells were washed twice and fixed overnight at 4 degree Celsius with fixative. Cells were pelleted, fixative removed, and cells were permeabilized with 150 μL/well True-Nuclear permeabilization buffer for 1 hour at 25 degree Celsius. Cells were pelleted and suspended in 50 μL/well of 1 ug/ml FOXP3-AF647 (clone 206D) diluted in permeablization buffer for 1 hour. Cells were washed twice with permeabilization buffer and once with FACS buffer. Cells were analyzed on a LSRII (Becton Dickinson, USA) flow cytometer and mean fluorescence intensity (MFI) determined using FlowJo software (FlowJo, USA, v10.2).

As shown in Table E17, the tested multi-domain immunomodulatory proteins were observed to promote the generation of induced regulatory T-cells (iTregs)

TABLE E17

| Regulatory T-cell Induction by Assayed Multi-domain Immunmodulatory Proteins | | | | | | | | |
|---|---|---|---|---|---|---|---|---|
| | | | % CD25 Hi FoxP3 + | | | CD25 Hi FoxP3 + Cell Number | | |
| Description/ Format | Treatment | SEQ ID NO | 100 (nM) | 33 (nM) | 11 (nM) | 100 (nM) | 33 (nM) | 11 (nM) |
| Trans | PD-L1 303 – CTLA-4 3495 – Fc | 3518 | 19.1 | 15.2 | 17.2 | 27318 | 17626 | 21256 |
| | PD-L1 303 – CTLA-4 3495 – Fc | 3518 | 19.6 | 17.1 | 16 | 25012 | 20994 | 18880 |
| | PD-L1 303 – CTLA-4 2655 – Fc | 3521 | 30.3 | 22.8 | 19.5 | 55482 | 35282 | 28146 |
| | PD-L1 303 – CTLA-4 2655 – Fc | 3521 | 22.9 | 21.9 | 16.8 | 40094 | 33060 | 22338 |
| | CTLA-4 3037 – PD-L1 303 – Fc | 3522 | 8.51 | 29.5 | 37 | 1908 | 34446 | 79102 |
| | PD-L1 303 – CTLA-4 3037 – Fc | 3523 | 44.2 | 33.6 | 27.6 | 86908 | 63640 | 47410 |
| | PD-L1 303 – CTLA-4 3037 – Fc | 3523 | 31.8 | 22.6 | 21 | 53954 | 37048 | 31034 |
| Cis Flag-His | PD-L1 303 – PD-L1 303 – ICOSL 2264 – ICOSL 2264 | 3500 | 4.28 | 9.95 | 20.2 | 498 | 1940 | 9534 |
| | PD-L1 303 – ICOSL 2264 – PD-L1 303 | 3501 | 23.2 | 17.3 | 21.5 | 22646 | 11714 | 19352 |
| | PD-L1 303 – ICOSL 2264 – ICOSL 2264 – PD-L1 303 | 3502 | 0.89 | 1.82 | 4.46 | 78 | 292 | 2354 |
| | PD-L1 303 – COMP | 3506 | 23.5 | 18.6 | 22.1 | 32546 | 22756 | 29282 |
| | PD-L1 303 – ICOSL 2264 – COMP | 3507 | 21 | 17.9 | 18.5 | 29166 | 22636 | 24190 |
| | PD-L1 303 – ICOSL 2264 | 3496 | 21.7 | 17.6 | 20.2 | 34496 | 22440 | 29074 |
| Cis Fc | PD-L1 303 – ICOSL 2266 – Fc | 3516 | 19.2 | 15.9 | 19.3 | 27668 | 20502 | 27070 |
| | PD-L1 303 – ICOSL 2264 – Fc | 3517 | 6.6 | 15.8 | 30 | 1298 | 12248 | 65504 |
| | PD-L1 303 – ICOSL 2266 – Fc + Fc | 3513 + 3514 | 24.9 | 18.1 | 20 | 29954 | 20586 | 26398 |
| | PD-L1 303 – ICOSL 2264 – Fc + Fc | 3515 + 3514 | 29.8 | 18.2 | 21 | 51758 | 24752 | 31466 |
| | PD-L1 303 – Fc + Fc | 3533 + 3534 | 25.9 | 24.3 | 18 | 28366 | 28448 | 21654 |
| | PD-L2 1417 – Fc + Fc | 3533 + 3512 | 26.8 | 20.7 | 20.8 | 32838 | 21640 | 27918 |
| Reference | Variant CTLA-4-Ig (belatacept) | | 2.83 | 2.58 | 2.34 | 332 | 378 | 386 |
| | CTLA-4 3037 – Fc | 3529 | 25.6 | 31.2 | 18 | 45974 | 70008 | 35110 |
| | PD-L1 303 – Fc | 3531 | 24.8 | 18.5 | 20.1 | 23404 | 17134 | 17020 |
| | ICOSL 2264 – Fc | 2264 | 3.96 | 3.12 | 3.25 | 540 | 382 | 468 |
| | Fc Control | 1175 | 23.7 | 19.6 | 24.2 | 25288 | 22186 | 28474 |
| Assay Controls | K562s alone | | 6 | — | — | 3 | — | — |
| | Naïve CD4+ T Cells alone | | 0.022 | — | — | 2 | — | — |
| | No Fc Ctrl | | 16.7 | — | — | 13236 | — | — |

Example 16

Assessment of T Cell Activation by Cis and Trans Multi-Domain Immunomodulatory Proteins in Staphylococcal Enterotoxin B (SEB) Assay This Example further describes bioactivity of exemplary multi-domain immunomodulatory proteins in human primary T cells.

The multi-domain immunomodulatory proteins were tested in a Staphylococcal enterotoxin B (SEB) assay. Peripheral blood mononuclear cells (PBMC) were labeled with 0.25 uM carboxyfluorescein succinimidyl ester. 200,000 PBMC/well were incubated with 50 ng/mL SEB and titrated multi-domain immunomodulatory proteins or control proteins were added at a final concentration of 100,000-1 pM. Cultures were placed in a 37 degree Celsius, 5% CO2 incubator for four days. Supernatants were collected and the level of secreted IL-2 or IFN-gamma was quantitated by ELISA analysis (BD Biosciences, USA).

Figure 20:
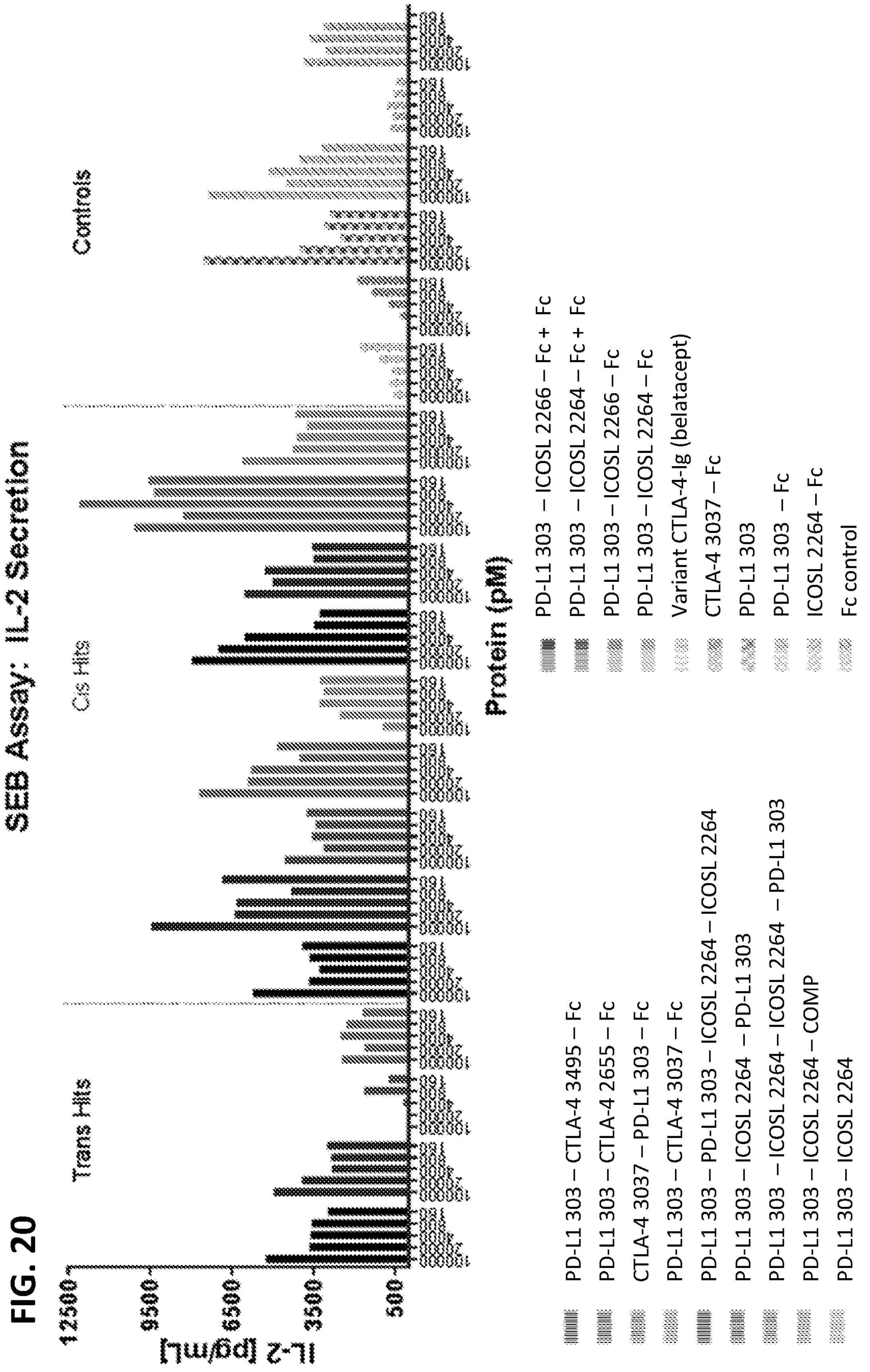
FIG. 20 shows results from a Staphylococcal enterotoxin B (SEB) assay assessing bioactivity of PD-L1, ICOSL and/or CTLA-4-containing multi-domain immunomodulatory proteins.

As shown in FIG. 20, the tested multi-domain immunomodulatory proteins exhibited SEB inflammatory response including agonist and antagonist activity.

In another experiment, additional exemplary multi-domain immunomodulatory proteins described in Example 1 were assessed in the SEB assay. Exemplary results are shown in Table E18. As shown, a number of the tested multi-domain immunomodulatory proteins exhibited antagonistic activity in the SEB assay compared to Fc only control.

TABLE E18

| SEB Assay | | |
|---|---|---|
| Description | SEQ ID NO | 100 nM IFN-gamma (pg/mL) |
| CTLA-4 3037 – PD-L1 303 – Fc | 3666 | 2048 |
| PD-L1 303 – CTLA-4 3037 – Fc | 3668 | 6104 |
| CTLA-4 3037 – Fc-PD-L1 303 | 3670 | 1573 |
| CTLA4 3037 – Fc-PD-L1 303 | 3672 | 2069 |
| CTLA-4 3060 – PD-L1 303 – Fc | 3674 | 3788 |
| PD-L1 303 – CTLA4 3060 – Fc | 3676 | 4467 |
| PD-L1 303 – 3xG4S – ICOSL 2264 – G4S ZZ12.6 FLAG His6 | 3678 | 6340 |
| CD58 3650 – PD-L1 303 – Fc | 3680 | 5445 |
| PD-L1 303 – CD58 3650 – Fc | 3682 | 9820 |
| PD-L1 303 – PD-L1 303 – CD58 3650 – CD58 3650 | 3684 | 8619 |
| CD58 3650 – CD58 3650 – PD-L1 303 – PD-L1 303 | 3686 | 6028 |
| CD58 3650 – PD-L1 303 – PD-L1 303 – CD58 3650 | 3688 | 16151 |
| CD155 665 – CD58 3650 – Fc | 3660 | 5846 |
| CD58 3650 – CD155 665 – Fc | 3662 | 6486 |
| CTLA-4 3060 – CD 155 665 – Fc | 3652 | 1904 |
| CD 155 665 – CTLA-4 3037 – Fc | 3654 | 4310 |
| PD-L1 303 – CD155 665 – CTLA-4 3037 – Fc | 3664 | 2643 |
| CD 155 665 – ICOSL 2264 – ICOSL 2264 – CD 155 665 | 3658 | 2118 |
| PD-L1 303 – CD155 665 – CTLA-4 3037 – Fc | 3664 | 7347 |
| CD 155 665 G4S FLAGHis | CD 155 IgV (665) | 10256 |

TABLE E18-continued

| SEB Assay | | |
|---|---|---|
| Description | SEQ ID NO | 100 nM IFN-gamma (pg/mL) |
| | Flag (2010) His (2011) | |
| ICOSL 2264 IgV − Fc | ICOSL IgV (2264) Fc (1715) | 1969 |
| CTLA4 3037 − Fc | CTLA-4 ECD (3037) Fc (1715) | 807 |
| Belatacept | | 1922 |
| CD58 (WT) 3650 − Fc | CD58 WT IgV (3650) Fc (1715) | 9660 |
| Fc control | 1715 | 10805 |

Example 17

Assessment of Bioactivity of Multi-Domain Immunomodulatory Proteins Containing Activating and Inhibitory Components Using Reporter Cells This Example describes a Jurkat/IL2, Jurkat/IL2/PD-1, and Jurkat/IL2/TIGIT reporter assay to assess inhibitory activity of exemplary multi-domain immunomodulatory proteins generated and described in Example 1. Jurkat reporter cells expressing an IL-2-luciferase reporter (Jurkat/IL2) or the reporter cells that also were transduced to stably express PD1 (Jurkat/IL2/PD1), or or TIGIT (Jurkat/IL2/TIGIT) were added to a microwell plate at a total of 100,000 cells per well. To each well, exemplary multi-domain proteins were added to the wells at 100,000 pM to 32 pM, 1:5 serial dilution of protein to cell and incubated for 15 minutes at room temperature. Approximately 20,000 K562/OKT3/CD80 aAPC described in Example 3 were added to the wells. Plate was spun for 10 seconds at 1200 rpm and then incubated for 5 hours at 37 degrees Celsius in a humidified 5% $CO_2$ incubation chamber. Luminescence was measured as described in Example 3.

Figure 21A:
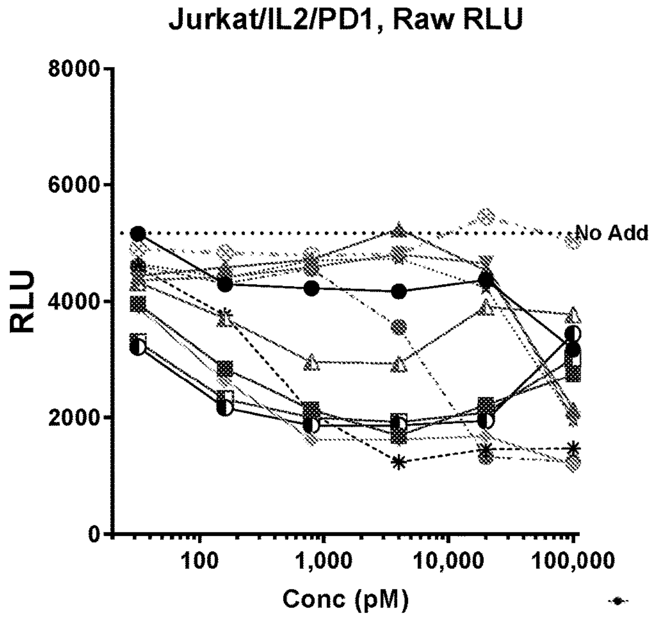
FIG. 21A-21E shows results from a Jurkat/IL and Jurkat/IL2/PD1 stimulation assay using exemplary PD-L1-CTLA4 and PD-L1-ICOSL multidomain immunomodulatory proteins.
Figure 21B:
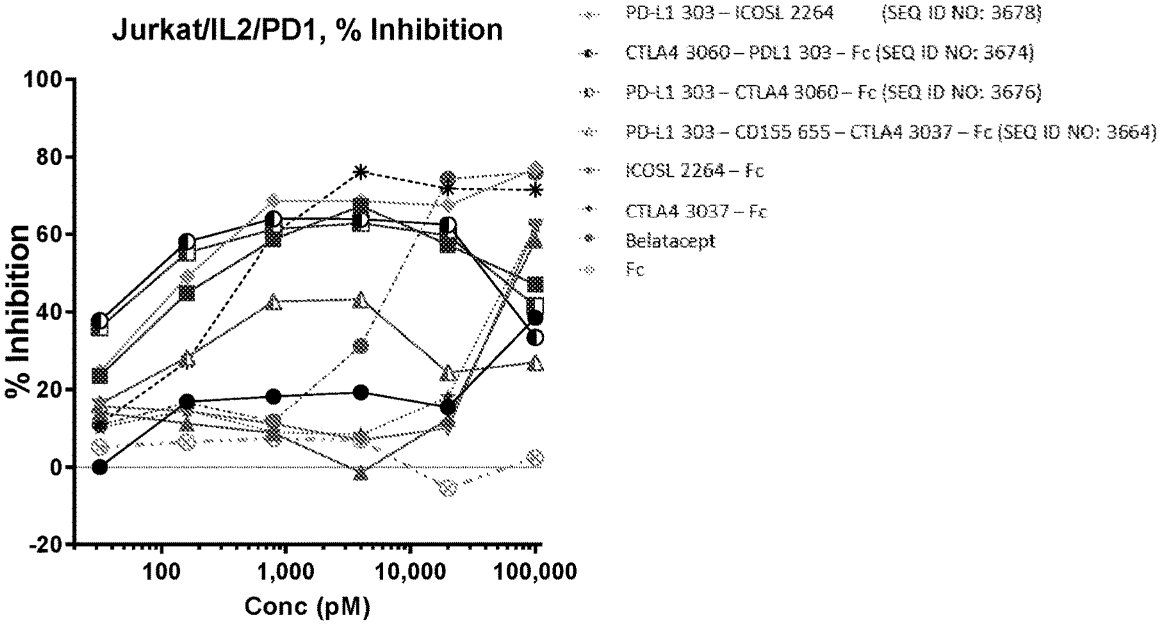
Figure 21C:
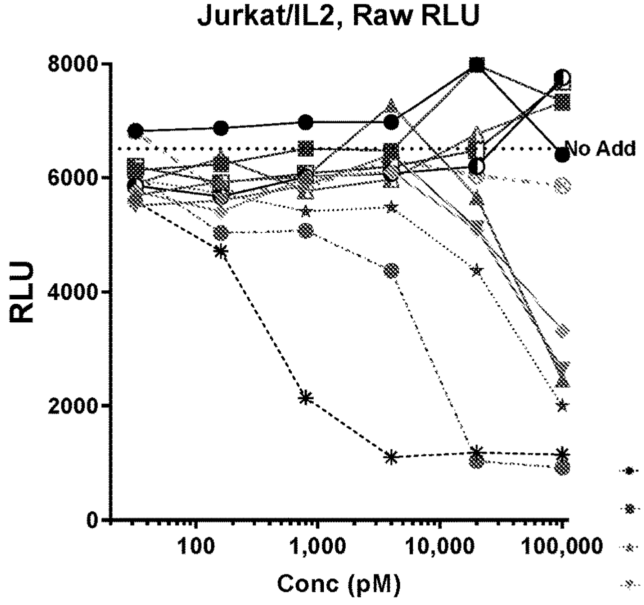
Figure 21C:
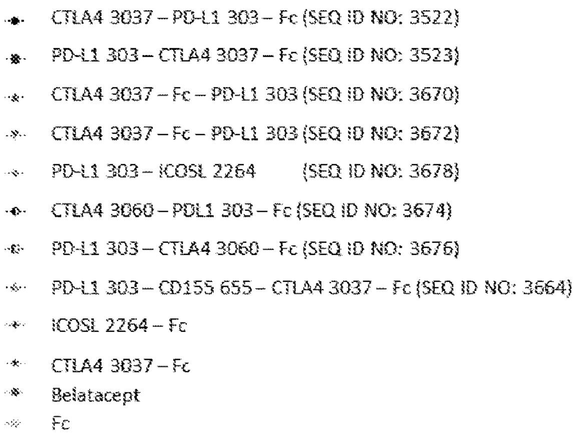
Figure 21D:
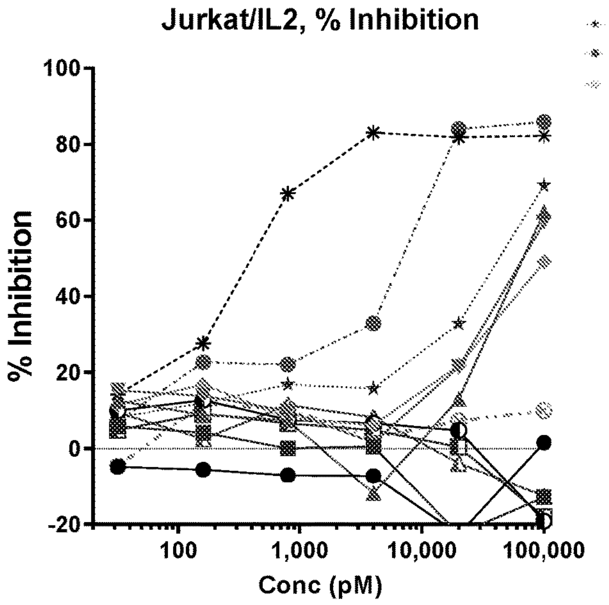

Results for exemplary PD-L1-CTLA-4 and PD-L1-ICOSL multidomain immunomodulatory proteins are shown in FIGS. 21A-E using the Jurkat/IL2 and Jurkat/IL2/PD1 assays. Results for exemplary CD58-PD-L1 and CD58-ICOSL multidomain immunomodulatory proteins are shown in FIGS. 22A-E using the Jurkat/IL2 and Jurkat/IL2/PD1 assays. Results for exemplary CD155-CTLA-4, CD155-CD58 and CD155-ICOSL multidomain immunomodulatory proteins are shown in FIGS. 23A-E using the Jurkat/IL-2 and Jurkat/IL2/TIGIT assays. The raw luminescence units (RLU) for tested immunomodulatory proteins are shown in FIGS. 21A and C, FIGS. 22A and C and FIGS. 23A and C for the Jurkat/IL2/PD-1 or TIGIT reporter cells or Jurkat/IL-2 cells, respectively. The percent inhibition was measured as the luminescence of the control−luminescence of cells incubated with exemplary protein/luminescence of control×100, and is shown in FIGS. 21B and D, FIGS. 22B and D and FIGS. 23B and D for the Jurkat/IL2/PD-1 or TIGIT reporter cells or Jurkat/IL-2 cells, respectively.

Figure 21E:
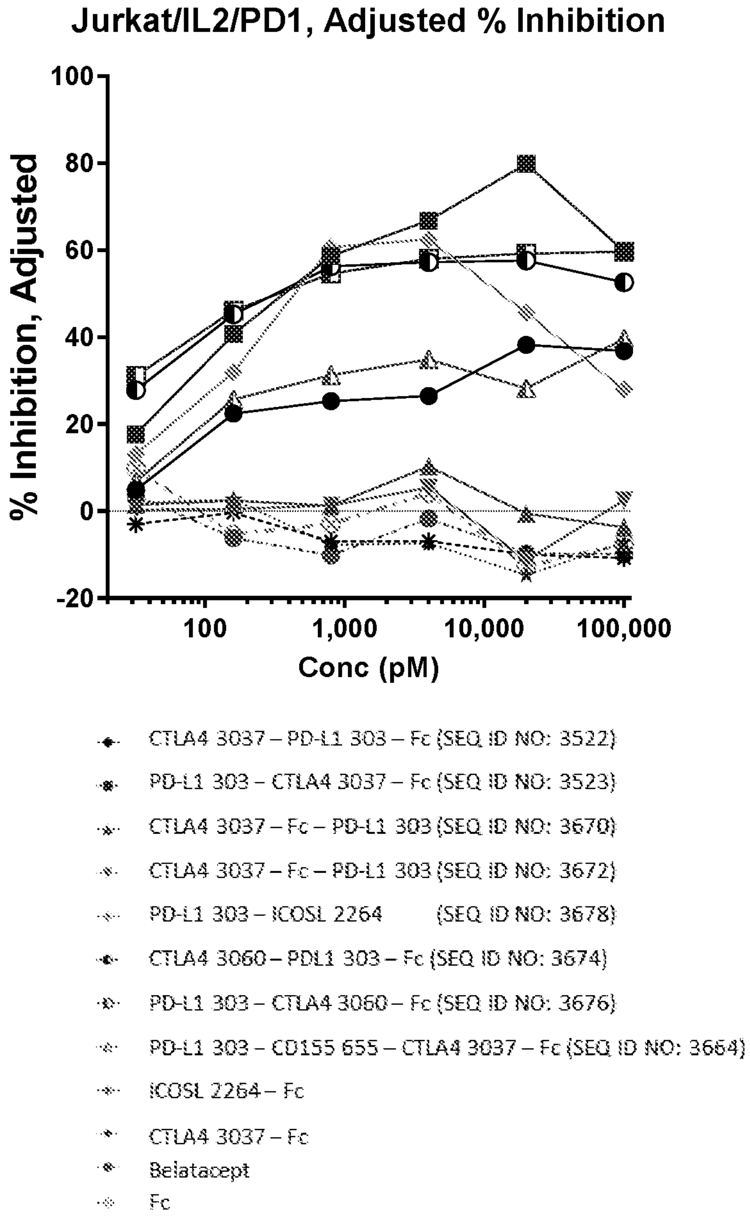
Figure 22A:
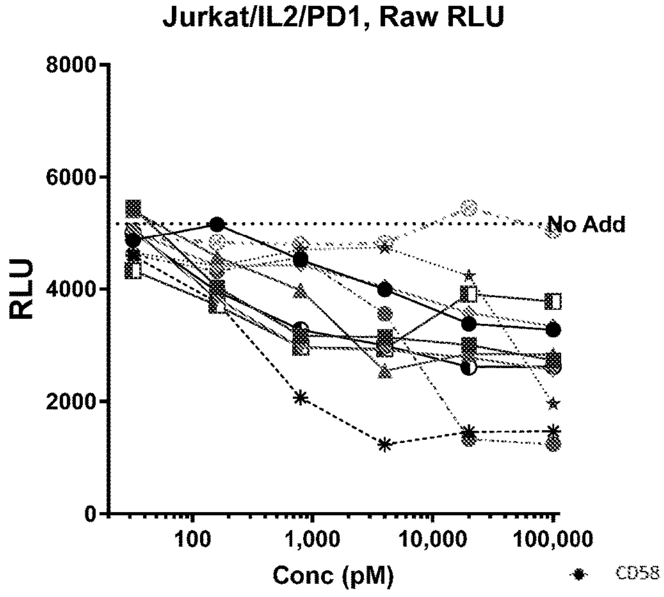
FIG. 22A-22E shows results from a Jurkat/IL2 and Jurkat/IL2/PD1 assay using using exemplary CD58-PD-L1 and CD58-ICOSL multidomain immunomodulatory proteins.
Figure 22B:
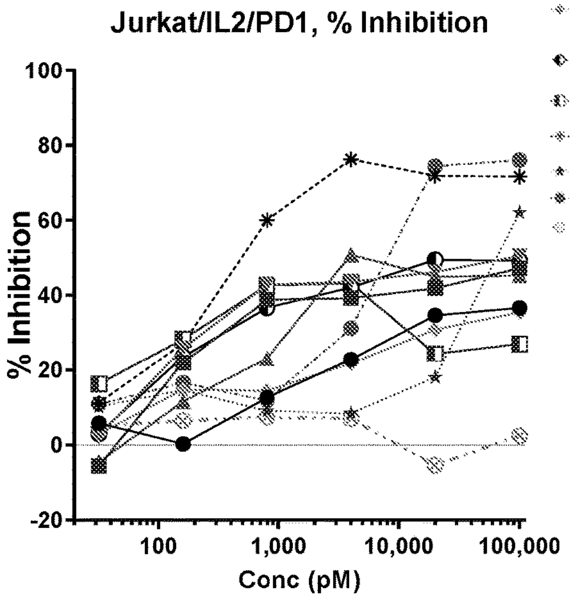
Figure 22C:
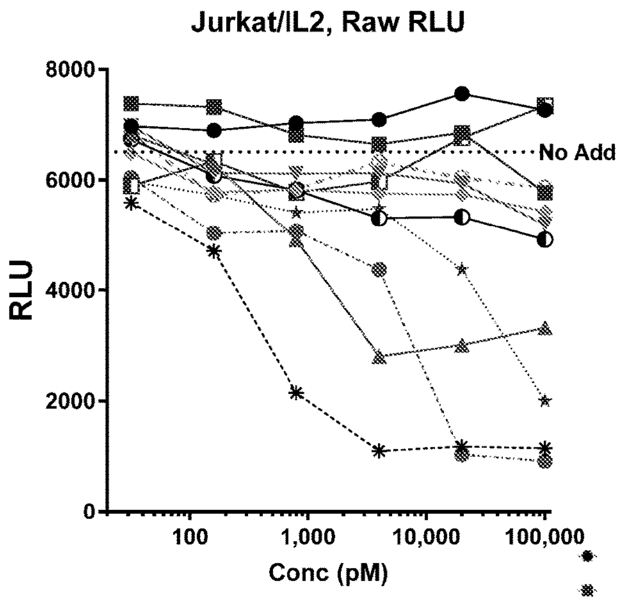
Figure 22D:
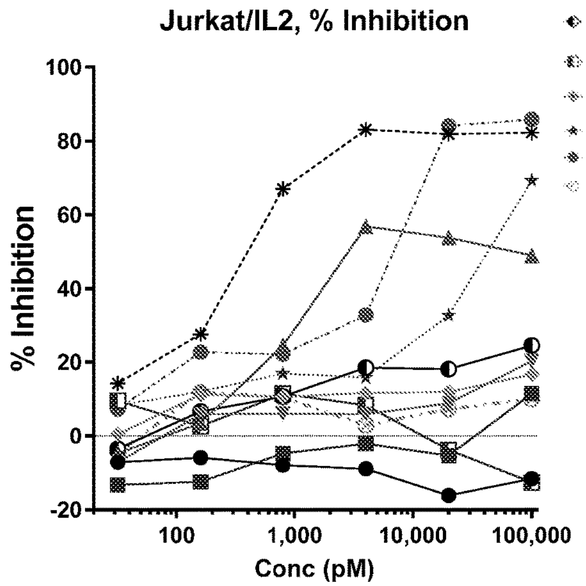
Figure 22E:
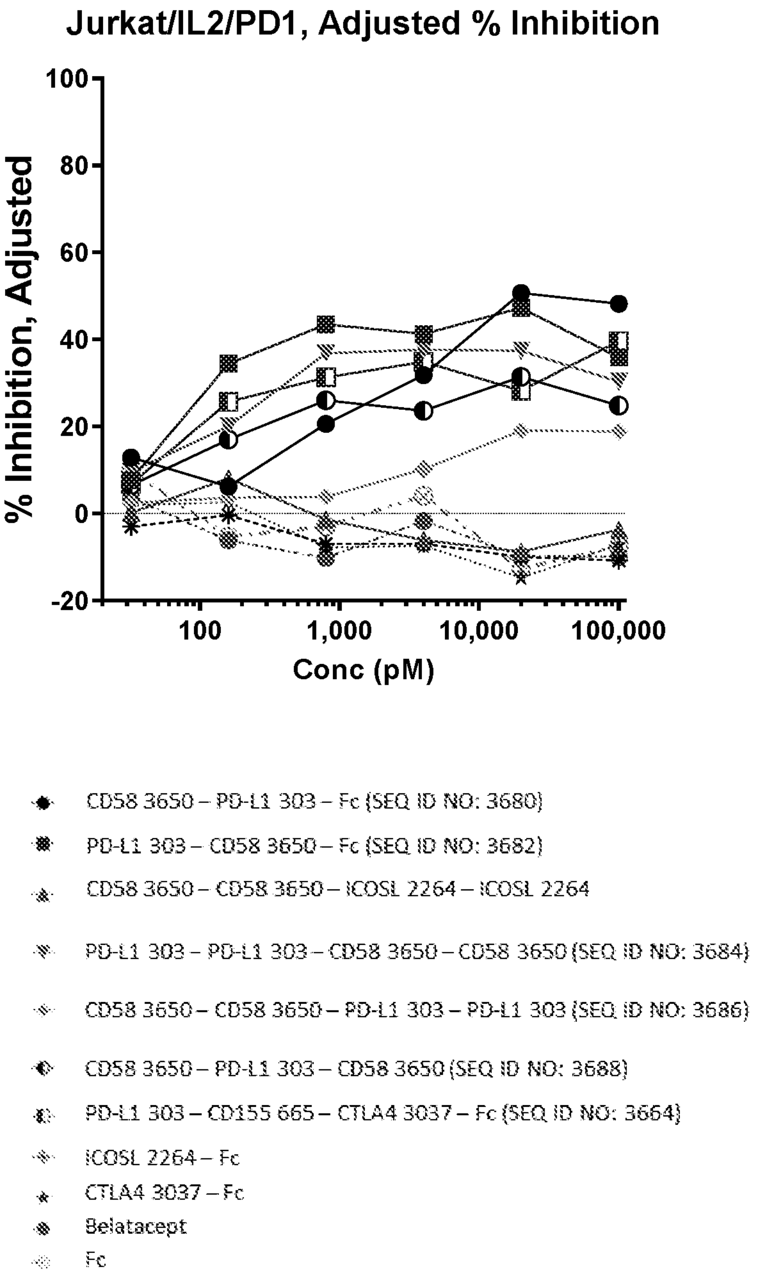
Figure 23A:
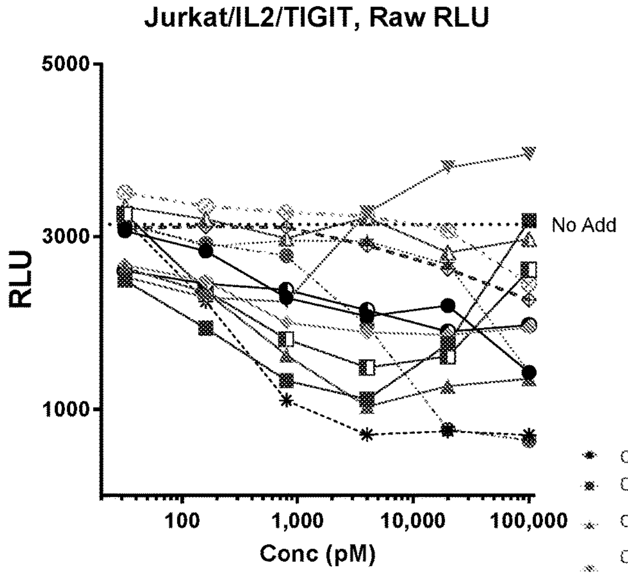
FIG. 23A-23E shows results from a Jurkat/IL2 and Jurkat/IL2/PD1 assay using exemplary CD155-CTLA-4, CD155-CD58, and CD155-ICOSL multidomain immunomodulatory proteins.
Figure 23A:
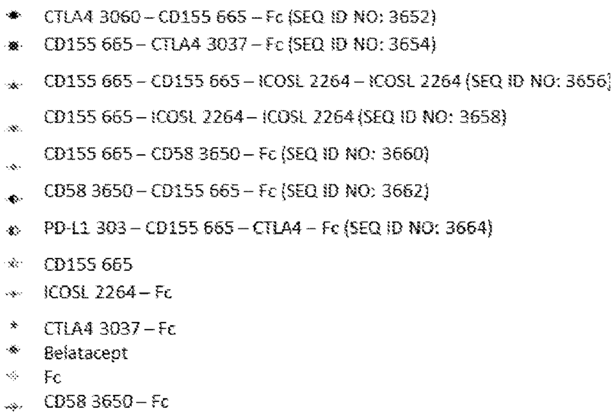
Figure 23B:
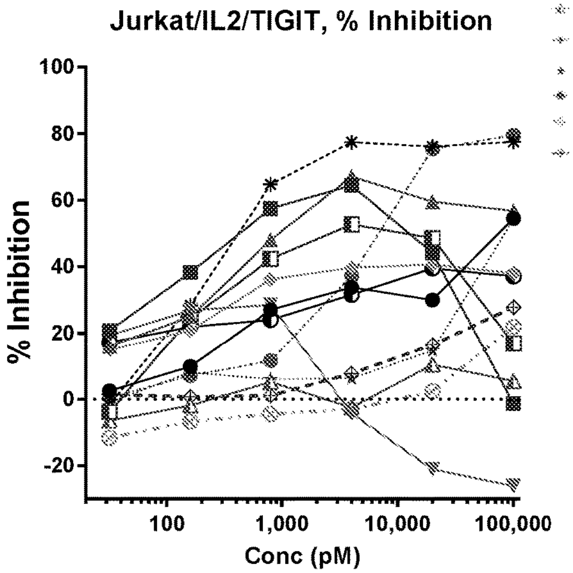
Figure 23C:
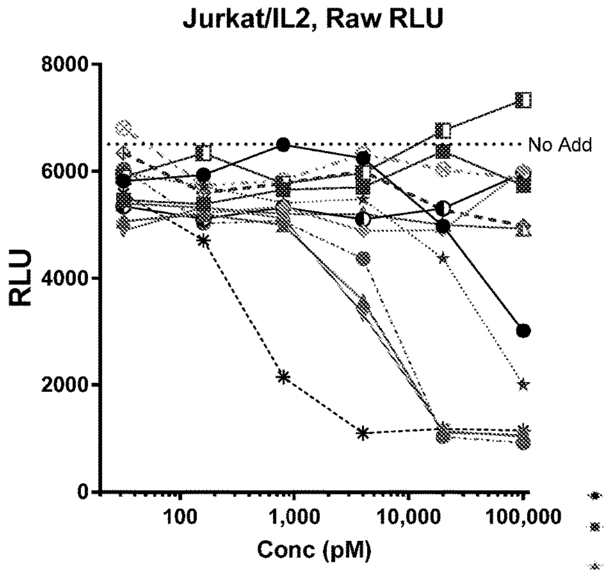
Figure 23D:
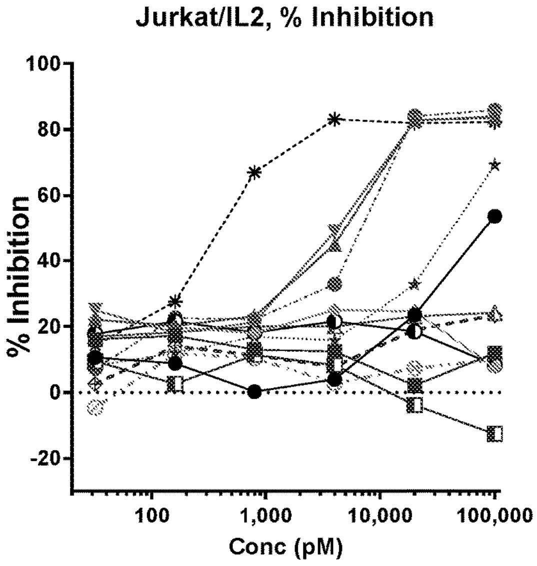
Figure 23E:
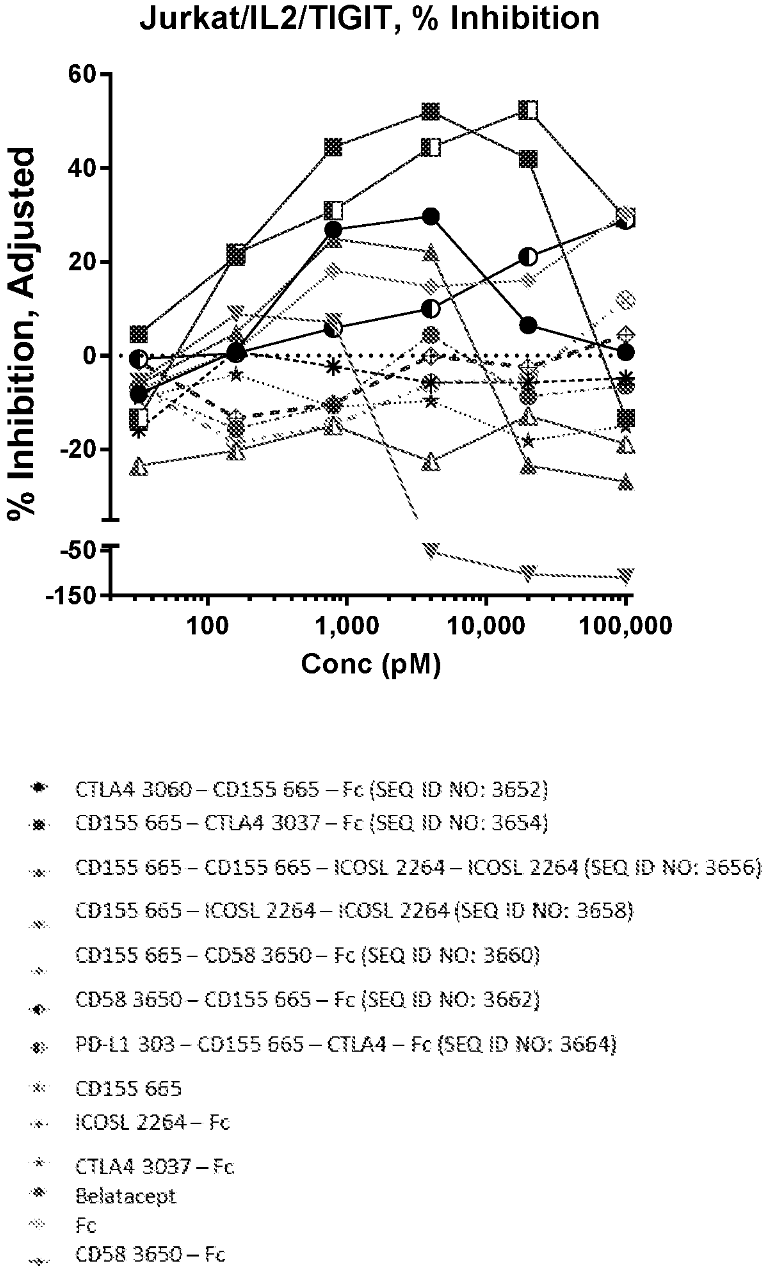

Adjusted inhibition was determined to assess if differential inhibition was observed in the Jurkat/IL2/PD-1 or TIGIT reporter cells versus Jurkat/IL-2 cells as a measure of contribution of the inhibitory structure and ligand. Adjusted inhibition was calculated as the percent of inhibition with an exemplary protein−percent inhibition without an exemplary protein. More specifically, PD-L1=(% Inhibition Jurkat/IL-2/PD-1)−(% Inhibition Jurkat/IL-2) and CD155=(% Inhibition Jurkat/IL-2/TIGIT)−(% Inhibition Jurkat/IL-2). Results for adjusted inhibition for exemplary assessed multidomain proteins and controls are shown in FIGS. 21E, 22E and 23E. As shown, an increased percent inhibition was observed for tested immunomodulatory proteins in this assay.

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (3688 sequences)

SEQ ID NO: 1 - protein, 288 aa, Homo sapiens
  MISC_FEATURE: CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2 - protein, 329 aa, Homo sapiens
  MISC_FEATURE: CD86(B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 3 - protein, 290 aa, Homo sapiens
  MISC_FEATURE: CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 4 - protein, 273 aa, Homo sapiens
  MISC_FEATURE: PDCD1LG2(PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 5 - protein, 302 aa, Homo sapiens
  MISC_FEATURE: ICOSLG(B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 6 - protein, 534 aa, Homo sapiens
  MISC_FEATURE: CD276(B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 7 - protein, 282 aa, Homo sapiens
  MISC_FEATURE: VTCN1(B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 8 - protein, 220 aa, Homo sapiens
  MISC_FEATURE: CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 9 - protein, 223 aa, Homo sapiens
  MISC_FEATURE: CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 10 - protein, 288 aa, Homo sapiens
  MISC_FEATURE: PDCD1(PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 11 - protein, 199 aa, Homo sapiens
  MISC_FEATURE: ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 12 - protein, 289 aa, Homo sapiens
  MISC_FEATURE: BTLA(CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 13 - protein, 458 aa, Homo sapiens
  MISC_FEATURE: CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 14 - protein, 235 aa, Homo sapiens
  MISC_FEATURE: CD8A(CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 15 - protein, 210 aa, Homo sapiens
  MISC_FEATURE: CD8B(CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 16 - protein, 525 aa, Homo sapiens
  MISC_FEATURE: LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 17 - protein, 301 aa, Homo sapiens
  MISC_FEATURE: HAVCR2(TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 18 - protein, 526 aa, Homo sapiens
  MISC_FEATURE: CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 19 - protein, 244 aa, Homo sapiens
  MISC_FEATURE: TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 20 - protein, 417 aa, Homo sapiens
  MISC_FEATURE: PVR(CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 21 - protein, 538 aa, Homo sapiens
  MISC_FEATURE: PVRL2(CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 22 - protein, 336 aa, Homo sapiens
  MISC_FEATURE: CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 23 - protein, 351 aa, Homo sapiens
  MISC_FEATURE: CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 24 - protein, 180 aa, Homo sapiens
  MISC_FEATURE: CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 25 - protein, 278 aa, Homo sapiens
  MISC_FEATURE: CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 26 - protein, 325 aa, Homo sapiens [sequence omitted]

SEQ ID NO: 27 - protein, 201 aa, Homo sapiens
  MISC_FEATURE: NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 28 - protein, 208 aa, Homo sapiens [sequence omitted]

SEQ ID NO: 29 - protein, 224 aa, Homo sapiens
  MISC_FEATURE: CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 30 - protein, 220 aa, Homo sapiens
  MISC_FEATURE: CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 31 - protein, 201 aa, Homo sapiens
  MISC_FEATURE: PDCD1LG2(PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 32 - protein, 238 aa, Homo sapiens [sequence omitted]

SEQ ID NO: 33 - protein, 438 aa, Homo sapiens
  MISC_FEATURE: CD276(B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 34 - protein, 235 aa, Homo sapiens
  MISC_FEATURE: VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 35 - protein, 134 aa, Homo sapiens
  MISC_FEATURE: CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 36 - protein, 126 aa, Homo sapiens [sequence omitted]

SEQ ID NO: 37 - protein, 150 aa, Homo sapiens [sequence omitted]

SEQ ID NO: 38 - protein, 120 aa, Homo sapiens
  MISC_FEATURE: ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 39 - protein, 127 aa, Homo sapiens
  MISC_FEATURE: BTLA(CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 40 - protein, 371 aa, Homo sapiens
  MISC_FEATURE: CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 41 - protein, 161 aa, Homo sapiens
  MISC_FEATURE: CD8A(CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 42 - protein, 149 aa, Homo sapiens
  MISC_FEATURE: CD8B(CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 43 - protein, 422 aa, Homo sapiens
  MISC_FEATURE: LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 44 - protein, 181 aa, Homo sapiens
  MISC_FEATURE: HAVCR2(TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 45 - protein, 394 aa, Homo sapiens
  MISC_FEATURE: CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 46 - protein, 120 aa, Homo sapiens
  MISC_FEATURE: TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 47 - protein, 323 aa, Homo sapiens
  MISC_FEATURE: PVR(CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 48 - protein, 329 aa, Homo sapiens
  MISC_FEATURE: PVRL2(CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 49 - protein, 236 aa, Homo sapiens [sequence omitted]

SEQ ID NO: 50 - protein, 185 aa, Homo sapiens
  MISC_FEATURE: CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 51 - protein, 133 aa, Homo sapiens
  MISC_FEATURE: CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 52 - protein, 202 aa, Homo sapiens
  MISC_FEATURE: CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 53 - protein, 215 aa, Homo sapiens
  MISC_FEATURE: CD200R1(CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 54 - protein, 117 aa, Homo sapiens
  MISC_FEATURE: NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 55 - protein, 107 aa, Artificial Sequence
  PD-L1 IgV
PKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKV

SEQ ID NO: 56 - protein, 220 aa, Artificial Sequence
  PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 57 - protein, 220 aa, Artificial Sequence
  PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 58 - protein, 220 aa, Artificial Sequence
  PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 59 - protein, 220 aa, Artificial Sequence
  PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 60 - protein, 220 aa, Artificial Sequence
  PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 61 - protein, 220 aa, Artificial Sequence
  PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 62 - protein, 220 aa, Artificial Sequence
  PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 63 - protein, 220 aa, Artificial Sequence
  PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 64 - protein, 220 aa, Artificial Sequence
  PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 65 - protein, 220 aa, Artificial Sequence
  PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 66 - protein, 220 aa, Artificial Sequence
  PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 67 - protein, 220 aa, Artificial Sequence
  PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 68 - protein, 220 aa, Artificial Sequence
  PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 69 - protein, 220 aa, Artificial Sequence
  PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 70 - protein, 220 aa, Artificial Sequence
  PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 71 - protein, 220 aa, Artificial Sequence
  PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 72 - protein, 220 aa, Artificial Sequence
  PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 73 - protein, 220 aa, Artificial Sequence
  PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 74 - protein, 220 aa, Artificial Sequence
  PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 75 - protein, 220 aa, Artificial Sequence
  PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 76 - protein, 220 aa, Artificial Sequence
  PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 77 - protein, 220 aa, Artificial Sequence
  PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 78 - protein, 220 aa, Artificial Sequence
  PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 79 - protein, 220 aa, Artificial Sequence
  PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 80 - protein, 220 aa, Artificial Sequence
  PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 81 - protein, 220 aa, Artificial Sequence
  PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 82 - protein, 220 aa, Artificial Sequence
  PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 83 - protein, 220 aa, Artificial Sequence
  PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 84 - protein, 220 aa, Artificial Sequence
  PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 85 - protein, 220 aa, Artificial Sequence
  PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 86 - protein, 220 aa, Artificial Sequence
  PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 87 - protein, 220 aa, Artificial Sequence
  PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 88 - protein, 220 aa, Artificial Sequence
  PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 89 - protein, 220 aa, Artificial Sequence
  PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 90 - protein, 220 aa, Artificial Sequence
  PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 91 - protein, 220 aa, Artificial Sequence
  PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 92 - protein, 220 aa, Artificial Sequence
  PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 93 - protein, 220 aa, Artificial Sequence
  PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 94 - protein, 220 aa, Artificial Sequence
  PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 95 - protein, 220 aa, Artificial Sequence
  PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 96 - protein, 220 aa, Artificial Sequence
  PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 97 - protein, 220 aa, Artificial Sequence
  PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 98 - protein, 220 aa, Artificial Sequence
  PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 99 - protein, 220 aa, Artificial Sequence
  PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 100 - protein, 220 aa, Artificial Sequence
  PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 101 - protein, 220 aa, Artificial Sequence
  PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 102 - protein, 220 aa, Artificial Sequence
  PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 103 - protein, 220 aa, Artificial Sequence
  PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 104 - protein, 220 aa, Artificial Sequence
  PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 105 - protein, 220 aa, Artificial Sequence
  PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 106 - protein, 220 aa, Artificial Sequence
  PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 107 - protein, 220 aa, Artificial Sequence
  PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 108 - protein, 220 aa, Artificial Sequence
  PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 109 - protein, 220 aa, Artificial Sequence
  PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 110 - protein, 220 aa, Artificial Sequence; identical to SEQ ID NO: 66
  PD-L1 ECD v55

SEQ ID NO: 111 - protein, 220 aa, Artificial Sequence
  PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 112 - protein, 220 aa, Artificial Sequence
  PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 113 - protein, 220 aa, Artificial Sequence
  PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 114 - protein, 220 aa, Artificial Sequence
  PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 115 - protein, 221 aa, Artificial Sequence
  PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 116 - protein, 220 aa, Artificial Sequence
  PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 117 - protein, 220 aa, Artificial Sequence
  PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 118 - protein, 220 aa, Artificial Sequence
  PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 119 - protein, 220 aa, Artificial Sequence
  PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 120 - protein, 220 aa, Artificial Sequence
  PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 121 - protein, 107 aa, Artificial Sequence
  PD-L1 IgV v1
PKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKV

SEQ ID NO: 122 - protein, 107 aa, Artificial Sequence
  PD-L1 IgV v2
PKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKV

SEQ ID NO: 123 - protein, 107 aa, Artificial Sequence
  PD-L1 IgV v3
PKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKV

SEQ ID NO: 124 - protein, 107 aa, Artificial Sequence
  PD-L1 IgV v4
SKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKV

SEQ ID NO: 125 - protein, 107 aa, Artificial Sequence
  PD-L1 IgV v5
PKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKV

SEQ ID NO: 126 - protein, 107 aa, Artificial Sequence
  PD-L1 IgV v6
PKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKV

SEQ ID NO: 127 - protein, 107 aa, Artificial Sequence
  PD-L1 IgV v7
PKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 128 - protein, 107 aa, Artificial Sequence
  PD-L1 IgV v8
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 129 - protein, 107 aa, Artificial Sequence
  PD-L1 IgV v9
PKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKV

SEQ ID NO: 130 - protein, 107 aa, Artificial Sequence
  PD-L1 IgV v10
PKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKV

SEQ ID NO: 131 - protein, 107 aa, Artificial Sequence
  PD-L1 IgV v11
PKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKV

SEQ ID NO: 132 - protein, 107 aa, Artificial Sequence
  PD-L1 IgV v12
PKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKV

SEQ ID NO: 133 - protein, 107 aa, Artificial Sequence
  PD-L1 IgV v13
PKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKV

SEQ ID NO: 134 - protein, 107 aa, Artificial Sequence
  PD-L1 IgV v14
PKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 135 - protein, 107 aa, Artificial Sequence
  PD-L1 IgV v15
PKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 136 - protein, 107 aa, Artificial Sequence
  PD-L1 IgV v16
PKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKV

SEQ ID NO: 137 - protein, 107 aa, Artificial Sequence
  PD-L1 IgV v17
PKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKV

SEQ ID NO: 138 - protein, 107 aa, Artificial Sequence
  PD-L1 IgV v18
PKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKV

SEQ ID NO: 139 - protein, 107 aa, Artificial Sequence
  PD-L1 IgV v19
PKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKV

SEQ ID NO: 140 - protein, 107 aa, Artificial Sequence
  PD-L1 IgV v20
PKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKV

SEQ ID NO: 141 - protein, 107 aa, Artificial Sequence
  PD-L1 IgV v21
PKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKV

SEQ ID NO: 142 - protein, 107 aa, Artificial Sequence
  PD-L1 IgV v22
PKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKV

SEQ ID NO: 143 - protein, 107 aa, Artificial Sequence
  PD-L1 IgV v23
PKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKV

SEQ ID NO: 144 - protein, 107 aa, Artificial Sequence
  PD-L1 IgV v24
PKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKV

SEQ ID NO: 145 - protein, 107 aa, Artificial Sequence
  PD-L1 IgV v25
PKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKV

SEQ ID NO: 146 - protein, 107 aa, Artificial Sequence
  PD-L1 IgV v26
PKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKV

SEQ ID NO: 147 - protein, 107 aa, Artificial Sequence
  PD-L1 IgV v27
PKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKV

SEQ ID NO: 148 - protein, 107 aa, Artificial Sequence
  PD-L1 IgV v28
PKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKV

SEQ ID NO: 149 - protein, 107 aa, Artificial Sequence
  PD-L1 IgV v29
PKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKV

SEQ ID NO: 150 - protein, 107 aa, Artificial Sequence
  PD-L1 IgV v30
PKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKV

SEQ ID NO: 151 - protein, 107 aa, Artificial Sequence
  PD-L1 IgV v31
PKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKV

SEQ ID NO: 152 - protein, 107 aa, Artificial Sequence
  PD-L1 IgV v32
PKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKV

SEQ ID NO: 153 - protein, 107 aa, Artificial Sequence
  PD-L1 IgV v33
PKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKV

SEQ ID NO: 154 - protein, 107 aa, Artificial Sequence
  PD-L1 IgV v34
PKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 155 - protein, 107 aa, Artificial Sequence
  PD-L1 IgV v35
PKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKV

SEQ ID NO: 156 - protein, 107 aa, Artificial Sequence
  PD-L1 IgV v36
PKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKV

SEQ ID NO: 157 - protein, 107 aa, Artificial Sequence
  PD-L1 IgV v37
PKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKV

SEQ ID NO: 158 - protein, 107 aa, Artificial Sequence
  PD-L1 IgV v38
PKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKV

SEQ ID NO: 159 - protein, 107 aa, Artificial Sequence
  PD-L1 IgV v39
PKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKV

SEQ ID NO: 160 - protein, 107 aa, Artificial Sequence
  PD-L1 IgV v40
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKV

SEQ ID NO: 161 - protein, 107 aa, Artificial Sequence
  PD-L1 IgV v41
PKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKV

SEQ ID NO: 162 - protein, 107 aa, Artificial Sequence
  PD-L1 IgV v42
PKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKV

SEQ ID NO: 163 - protein, 107 aa, Artificial Sequence
  PD-L1 IgV v43
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKV

SEQ ID NO: 164 - protein, 107 aa, Artificial Sequence
  PD-L1 IgV v44
PKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKV

SEQ ID NO: 165 - protein, 107 aa, Artificial Sequence
  PD-L1 IgV v45
PKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKV

SEQ ID NO: 166 - protein, 107 aa, Artificial Sequence
  PD-L1 IgV v46
PKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKV

SEQ ID NO: 167 - protein, 107 aa, Artificial Sequence
  PD-L1 IgV v47
PKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 168 - protein, 107 aa, Artificial Sequence
  PD-L1 IgV v48
PKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKV

SEQ ID NO: 169 - protein, 107 aa, Artificial Sequence
  PD-L1 IgV v49
PKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKV

SEQ ID NO: 170 - protein, 107 aa, Artificial Sequence
  PD-L1 IgV v50
PKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKV

SEQ ID NO: 171 - protein, 107 aa, Artificial Sequence
  PD-L1 IgV v51
PKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKV

SEQ ID NO: 172 - protein, 107 aa, Artificial Sequence
  PD-L1 IgV v52
PKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKV

SEQ ID NO: 173 - protein, 107 aa, Artificial Sequence
  PD-L1 IgV v53
PKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKV

SEQ ID NO: 174 - protein, 107 aa, Artificial Sequence
  PD-L1 IgV v54
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKV

SEQ ID NO: 175 - protein, 107 aa, Artificial Sequence; identical to SEQ ID NO: 131
  PD-L1 IgV v55

SEQ ID NO: 176 - protein, 107 aa, Artificial Sequence
  PD-L1 IgV v56
PKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKV

SEQ ID NO: 177 - protein, 107 aa, Artificial Sequence
  PD-L1 IgV v57
PKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKV

SEQ ID NO: 178 - protein, 107 aa, Artificial Sequence
  PD-L1 IgV v58
PKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKV

SEQ ID NO: 179 - protein, 107 aa, Artificial Sequence
  PD-L1 IgV v59
PKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKV

SEQ ID NO: 180 - protein, 108 aa, Artificial Sequence
  PD-L1 IgV v60
PKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKV

SEQ ID NO: 181 - protein, 107 aa, Artificial Sequence
  PD-L1 IgV v61
PKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKV

SEQ ID NO: 182 - protein, 107 aa, Artificial Sequence
  PD-L1 IgV v62
PKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKV

SEQ ID NO: 183 - protein, 107 aa, Artificial Sequence
  PD-L1 IgV v63
PKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKV

SEQ ID NO: 184 - protein, 107 aa, Artificial Sequence
  PD-L1 IgV v64
PKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKV

SEQ ID NO: 185 - protein, 107 aa, Artificial Sequence
  PD-L1 IgV v65
PKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKV

SEQ ID NO: 186 - protein, 19 aa, Artificial Sequence
  VH signal peptide
MGSTAILALLLAVLQGVSA

SEQ ID NO: 187 - protein, 232 aa, Artificial Sequence
  IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 235 aa, Artificial Sequence
  IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 189 - protein, 254 aa, Homo sapiens
  MISC_FEATURE: Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 190 - protein, 306 aa, Homo sapiens
  MISC_FEATURE: Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 191 - protein, 272 aa, Homo sapiens
  MISC_FEATURE: Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 192 - protein, 254 aa, Homo sapiens
  MISC_FEATURE: Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 193 - protein, 284 aa, Homo sapiens
  MISC_FEATURE: Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 194 - protein, 506 aa, Homo sapiens
  MISC_FEATURE: Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 195 - protein, 258 aa, Homo sapiens
  MISC_FEATURE: Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 196 - protein, 202 aa, Homo sapiens
  MISC_FEATURE: Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 197 - protein, 188 aa, Homo sapiens
  MISC_FEATURE: Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 198 - protein, 268 aa, Homo sapiens
  MISC_FEATURE: Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 199 - protein, 179 aa, Homo sapiens
  MISC_FEATURE: Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 200 - protein, 259 aa, Homo sapiens
  MISC_FEATURE: Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 201 - protein, 433 aa, Homo sapiens
  MISC_FEATURE: Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 202 - protein, 214 aa, Homo sapiens
  MISC_FEATURE: Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 203 - protein, 189 aa, Homo sapiens
  MISC_FEATURE: Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 204 - protein, 497 aa, Homo sapiens
  MISC_FEATURE: Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 205 - protein, 280 aa, Homo sapiens
  MISC_FEATURE: Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 206 - protein, 492 aa, Homo sapiens
  MISC_FEATURE: Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 207 - protein, 222 aa, Homo sapiens
  MISC_FEATURE: Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 208 - protein, 397 aa, Homo sapiens
  MISC_FEATURE: Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 209 - protein, 507 aa, Homo sapiens
  MISC_FEATURE: Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 210 - protein, 318 aa, Homo sapiens
  MISC_FEATURE: Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 211 - protein, 327 aa, Homo sapiens
  MISC_FEATURE: Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 212 - protein, 154 aa, Homo sapiens
  MISC_FEATURE: Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 213 - protein, 248 aa, Homo sapiens
  MISC_FEATURE: Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 214 - protein, 297 aa, Homo sapiens
  MISC_FEATURE: Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 215 - protein, 183 aa, Homo sapiens
  MISC_FEATURE: Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 216 - protein, 414 aa, Homo sapiens
  MISC_FEATURE: VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 217 - protein, 393 aa, Homo sapiens
  MISC_FEATURE: Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 218 - protein, 242 aa, Homo sapiens
  MISC_FEATURE: VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 219 - protein, 16 aa, Artificial Sequence
  CD33 Signal Peptide
MPLLLLLPLLWAGALA

SEQ ID NO: 220 - protein, 22 aa, Artificial Sequence
  IgGkappa light chain
MDMRVLAQLLGLLLLCFPGARC

SEQ ID NO: 221 - protein, 18 aa, Artificial Sequence
  HSA signal peptide
MKWVTFISLLFLFSSAYS

SEQ ID NO: 222 - protein, 22 aa, Artificial Sequence
  Ig kappa light chain
MDMRAPAGIFGFLLVLFPGYRS

SEQ ID NO: 223 - protein, 19 aa, Artificial Sequence
  Human azurocidin preprotein signal sequence
MTRLTVLALLAGLLASSRA

SEQ ID NO: 224 - protein, 19 aa, Artificial Sequence
  IgG heavy chain signal peptide
MELGLSWIFLLAILKGVQC

SEQ ID NO: 225 - protein, 19 aa, Artificial Sequence
  IgG heavy chain signal peptide
MELGLRWVFLVAILEGVQC

SEQ ID NO: 226 - protein, 19 aa, Artificial Sequence
  IgG heavy chain signal peptide
MKHLWFFLLLVAAPRWVLS

SEQ ID NO: 227 - protein, 19 aa, Artificial Sequence
  IgG heavy chain signal peptide
MDWTWRILFLVAAATGAHS

SEQ ID NO: 228 - protein, 19 aa, Artificial Sequence
  IgG heavy chain signal peptide
MDWTWRFLFVVAAATGVQS

SEQ ID NO: 229 - protein, 19 aa, Artificial Sequence
  IgG heavy chain signal peptide
MEFGLSWLFLVAILKGVQC

SEQ ID NO: 230 - protein, 19 aa, Artificial Sequence
  IgG heavy chain signal peptide
MEFGLSWVFLVALFRGVQC

SEQ ID NO: 231 - protein, 26 aa, Artificial Sequence
  IgG heavy chain signal peptide
MDLLHKNMKHLWFFLLLVAAPRWVLS

SEQ ID NO: 232 - protein, 22 aa, Artificial Sequence
  IgG Kappa light chain signal seqeunce
MDMRVPAQLLGLLLLWLSGARC

SEQ ID NO: 233 - protein, 22 aa, Artificial Sequence
  IgG Kappa light chain signal seqeunce
MKYLLPTAAAGLLLLAAQPAMA

SEQ ID NO: 234 - protein, 17 aa, Artificial Sequence
  Gaussia luciferase
MGVKVLFALICIAVAEA

SEQ ID NO: 235 - protein, 18 aa, Artificial Sequence
  Human albumin
MKWVTFISLLFLFSSAYS

SEQ ID NO: 236 - protein, 18 aa, Artificial Sequence
  Human chymotrypsinogen
MAFLWLLSCWALLGTTFG

SEQ ID NO: 237 - protein, 14 aa, Artificial Sequence
  Human interleukin-2
MQLLSCIALILALV

SEQ ID NO: 238 - protein, 15 aa, Artificial Sequence
  Human trysinogen-2
MNLLLILTFVAAAVA

SEQ ID NO: 239 - protein, 15 aa, Artificial Sequence
  Linker
GGGGSGGGGSGGGGS

SEQ ID NO: 240 - protein, 10 aa, Artificial Sequence
  Linker
GGGGSGGGGS

SEQ ID NO: 241 - protein, 13 aa, Artificial Sequence
  Linker
GGGGSGGGGSAAA

SEQ ID NO: 242 - protein, 71 aa, Artificial Sequence
  CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 243 - protein, 112 aa, Artificial Sequence
  CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 244 - protein, 114 aa, Artificial Sequence
  PD-L1 IgV v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNA

SEQ ID NO: 245 - protein, 114 aa, Artificial Sequence
  PD-L1 IgV v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNA

SEQ ID NO: 246 - protein, 114 aa, Artificial Sequence
  PD-L1 IgV v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNA

SEQ ID NO: 247 - protein, 114 aa, Artificial Sequence
  PD-L1 IgV v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNA

SEQ ID NO: 248 - protein, 114 aa, Artificial Sequence
  PD-L1 IgV v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNA

SEQ ID NO: 249 - protein, 114 aa, Artificial Sequence
  PD-L1 IgV v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNA

SEQ ID NO: 250 - protein, 114 aa, Artificial Sequence
  PD-L1 IgV v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 251 - protein, 114 aa, Artificial Sequence
  PD-L1 IgV v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 252 - protein, 114 aa, Artificial Sequence
  PD-L1 IgV v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 253 - protein, 114 aa, Artificial Sequence
  PD-L1 IgV v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNA

SEQ ID NO: 254 - protein, 114 aa, Artificial Sequence
  PD-L1 IgV v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNA

SEQ ID NO: 255 - protein, 114 aa, Artificial Sequence
  PD-L1 IgV v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNA

SEQ ID NO: 256 - protein, 114 aa, Artificial Sequence
  PD-L1 IgV v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNA

SEQ ID NO: 257 - protein, 114 aa, Artificial Sequence
  PD-L1 IgV v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 258 - protein, 114 aa, Artificial Sequence
  PD-L1 IgV v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 259 - protein, 114 aa, Artificial Sequence
  PD-L1 IgV v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 260 - protein, 114 aa, Artificial Sequence
  PD-L1 IgV v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNA

SEQ ID NO: 261 - protein, 114 aa, Artificial Sequence
  PD-L1 IgV v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNA

SEQ ID NO: 262 - protein, 114 aa, Artificial Sequence
  PD-L1 IgV v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNA

SEQ ID NO: 263 - protein, 114 aa, Artificial Sequence
  PD-L1 IgV v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNA

SEQ ID NO: 264 - protein, 114 aa, Artificial Sequence
  PD-L1 IgV v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNA

SEQ ID NO: 265 - protein, 114 aa, Artificial Sequence
  PD-L1 IgV v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNA

SEQ ID NO: 266 - protein, 114 aa, Artificial Sequence
  PD-L1 IgV v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNA

SEQ ID NO: 267 - protein, 114 aa, Artificial Sequence
  PD-L1 IgV v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNA

SEQ ID NO: 268 - protein, 114 aa, Artificial Sequence
  PD-L1 IgV v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNA

SEQ ID NO: 269 - protein, 114 aa, Artificial Sequence
  PD-L1 IgV v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNA

SEQ ID NO: 270 - protein, 114 aa, Artificial Sequence
  PD-L1 IgV v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNA

SEQ ID NO: 271 - protein, 114 aa, Artificial Sequence
  PD-L1 IgV v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNA

SEQ ID NO: 272 - protein, 114 aa, Artificial Sequence
  PD-L1 IgV v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNA

SEQ ID NO: 273 - protein, 114 aa, Artificial Sequence
  PD-L1 IgV v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNA

SEQ ID NO: 274 - protein, 114 aa, Artificial Sequence
  PD-L1 IgV v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNA

SEQ ID NO: 275 - protein, 114 aa, Artificial Sequence
  PD-L1 IgV v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNA

SEQ ID NO: 276 - protein, 114 aa, Artificial Sequence
  PD-L1 IgV v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNA

SEQ ID NO: 277 - protein, 114 aa, Artificial Sequence
  PD-L1 IgV v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 278 - protein, 114 aa, Artificial Sequence
  PD-L1 IgV v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNA

SEQ ID NO: 279 - protein, 114 aa, Artificial Sequence
  PD-L1 IgV v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNA

SEQ ID NO: 280 - protein, 114 aa, Artificial Sequence
  PD-L1 IgV v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNA

SEQ ID NO: 281 - protein, 114 aa, Artificial Sequence
  PD-L1 IgV v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNA

SEQ ID NO: 282 - protein, 114 aa, Artificial Sequence
  PD-L1 IgV v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNA

SEQ ID NO: 283 - protein, 114 aa, Artificial Sequence
  PD-L1 IgV v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNA

SEQ ID NO: 284 - protein, 114 aa, Artificial Sequence
  PD-L1 IgV v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNA

SEQ ID NO: 285 - protein, 114 aa, Artificial Sequence
  PD-L1 IgV v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNA

SEQ ID NO: 286 - protein, 114 aa, Artificial Sequence
  PD-L1 IgV v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNA

SEQ ID NO: 287 - protein, 114 aa, Artificial Sequence
  PD-L1 IgV v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNA

SEQ ID NO: 288 - protein, 114 aa, Artificial Sequence
  PD-L1 IgV v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNA

SEQ ID NO: 289 - protein, 114 aa, Artificial Sequence
  PD-L1 IgV v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 290 - protein, 114 aa, Artificial Sequence
  PD-L1 IgV v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 291 - protein, 114 aa, Artificial Sequence
  PD-L1 IgV v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNA

SEQ ID NO: 292 - protein, 114 aa, Artificial Sequence
  PD-L1 IgV v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNA

SEQ ID NO: 293 - protein, 114 aa, Artificial Sequence
  PD-L1 IgV v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 294 - protein, 114 aa, Artificial Sequence
  PD-L1 IgV v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNA

SEQ ID NO: 295 - protein, 114 aa, Artificial Sequence
  PD-L1 IgV v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNA

SEQ ID NO: 296 - protein, 114 aa, Artificial Sequence
  PD-L1 IgV v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNA

SEQ ID NO: 297 - protein, 114 aa, Artificial Sequence
  PD-L1 IgV v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNA

SEQ ID NO: 298 - protein, 114 aa, Artificial Sequence; identical to SEQ ID NO: 254
  PD-L1 IgV v55

SEQ ID NO: 299 - protein, 114 aa, Artificial Sequence
  PD-L1 IgV v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNA

SEQ ID NO: 300 - protein, 114 aa, Artificial Sequence
  PD-L1 IgV v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNA

SEQ ID NO: 301 - protein, 114 aa, Artificial Sequence
  PD-L1 IgV v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNA

SEQ ID NO: 302 - protein, 114 aa, Artificial Sequence
  PD-L1 IgV v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNA

SEQ ID NO: 303 - protein, 115 aa, Artificial Sequence
  PD-L1 IgV v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 304 - protein, 114 aa, Artificial Sequence
  PD-L1 IgV v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNA

SEQ ID NO: 305 - protein, 114 aa, Artificial Sequence
  PD-L1 IgV v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNA

SEQ ID NO: 306 - protein, 114 aa, Artificial Sequence
  PD-L1 IgV v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNA

SEQ ID NO: 307 - protein, 114 aa, Artificial Sequence
  PD-L1 IgV v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNA

SEQ ID NO: 308 - protein, 114 aa, Artificial Sequence
  PD-L1 IgV v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNA

SEQ ID NO: 309 - protein, 114 aa, Homo sapiens
  MISC_FEATURE: PD-L1 IgV wildtype
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNA

SEQ ID NO: 310 - protein, 116 aa, Homo sapiens
  MISC_FEATURE: CD155 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWL

SEQ ID NO: 311 - protein, 323 aa, Artificial Sequence
  CD155 v1 ECD
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 312 - protein, 323 aa, Artificial Sequence
  CD155 v2 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 313 - protein, 323 aa, Artificial Sequence
  CD155 v3 ECD
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 314 - protein, 323 aa, Artificial Sequence
  CD155 v4 ECD
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 315 - protein, 323 aa, Artificial Sequence
  CD155 v5 ECD
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 316 - protein, 323 aa, Artificial Sequence
  CD155 v6 ECD
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 317 - protein, 323 aa, Artificial Sequence
  CD155 v7 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 318 - protein, 323 aa, Artificial Sequence
  CD155 v8 ECD
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 319 - protein, 323 aa, Artificial Sequence
  CD155 v9 ECD
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 320 - protein, 323 aa, Artificial Sequence
  CD155 v10 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 321 - protein, 323 aa, Artificial Sequence
  CD155 v11 ECD
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 322 - protein, 323 aa, Artificial Sequence
  CD155 v12 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 323 - protein, 323 aa, Artificial Sequence
  CD155 v14 ECD
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 324 - protein, 323 aa, Artificial Sequence
  CD155 v15 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 325 - protein, 323 aa, Artificial Sequence
  CD155 v16 ECD
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 326 - protein, 323 aa, Artificial Sequence
  CD155 v17 ECD
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 327 - protein, 323 aa, Artificial Sequence
  CD155 v18 ECD
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 328 - protein, 323 aa, Artificial Sequence
  CD155 v19 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 329 - protein, 323 aa, Artificial Sequence
  CD155 v20 ECD
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 330 - protein, 323 aa, Artificial Sequence
  CD155 v21 ECD
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 331 - protein, 323 aa, Artificial Sequence
  CD155 v22 ECD
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 332 - protein, 116 aa, Artificial Sequence
  CD155 v1 IgV
PGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWL

SEQ ID NO: 333 - protein, 116 aa, Artificial Sequence
  CD155 v2 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWL

SEQ ID NO: 334 - protein, 116 aa, Artificial Sequence
  CD155 v3 IgV
PGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWL

SEQ ID NO: 335 - protein, 116 aa, Artificial Sequence
  CD155 v4 IgV
PGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWL

SEQ ID NO: 336 - protein, 116 aa, Artificial Sequence
  CD155 v5 IgV
PGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWL

SEQ ID NO: 337 - protein, 116 aa, Artificial Sequence
  CD155 v6 IgV
PGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 338 - protein, 116 aa, Artificial Sequence
  CD155 v7 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 339 - protein, 116 aa, Artificial Sequence
  CD155 v8 IgV
PGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWL

SEQ ID NO: 340 - protein, 116 aa, Artificial Sequence
  CD155 v9 IgV
PGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 341 - protein, 116 aa, Artificial Sequence
  CD155 v10 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWL

SEQ ID NO: 342 - protein, 116 aa, Artificial Sequence
  CD155 v11 IgV
PGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWL

SEQ ID NO: 343 - protein, 116 aa, Artificial Sequence
  CD155 v12 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWL

SEQ ID NO: 344 - protein, 116 aa, Artificial Sequence
  CD155 v14 IgV
PGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWL

SEQ ID NO: 345 - protein, 116 aa, Artificial Sequence
  CD155 v15 IgV
PGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWL

SEQ ID NO: 346 - protein, 116 aa, Artificial Sequence
  CD155 v16 IgV
PGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWL

SEQ ID NO: 347 - protein, 116 aa, Artificial Sequence
  CD155 v17 IgV
PGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWL

SEQ ID NO: 348 - protein, 116 aa, Artificial Sequence
  CD155 v18 IgV
PGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWL

SEQ ID NO: 349 - protein, 116 aa, Artificial Sequence
  CD155 v19 IgV
PGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWL

SEQ ID NO: 350 - protein, 116 aa, Artificial Sequence
  CD155 v20 IgV
PGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWL

SEQ ID NO: 351 - protein, 116 aa, Artificial Sequence
  CD155 v21 IgV
PGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWL

SEQ ID NO: 352 - protein, 116 aa, Artificial Sequence
  CD155 v22 IgV
PGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWL

SEQ ID NO: 353 - protein, 122 aa, Homo sapiens
  MISC_FEATURE: CD155 IgV wildtype
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVL

SEQ ID NO: 354 - protein, 122 aa, Artificial Sequence
  CD155 v1 IgV
WPPPGTGDVVVQAPTQVSGFLGDSVTLPCYLQVPNMEVTHVSQLTWARHGESGSMAVFHQTQGSSYSESKRLEFVAARLGAELRNASLRMSGLRVEDEGNYTCLFVTFPQGSRSVDIWLRVL

SEQ ID NO: 355 - protein, 122 aa, Artificial Sequence
  CD155 v2 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCPFVTFPQGSRSVDIWLRVL

SEQ ID NO: 356 - protein, 122 aa, Artificial Sequence
  CD155 v3 IgV
WPPPGTGDVVVQAPTQVPGFLGDSVTLPCYLQVPNMEVTHVSQPTWARHGESGSMAVFHQTQGPSYSESKRLEFVAARLGAELRNASLRMFGLRVEDEGNYTCLFVTFPQGSRSVDIWLRVL

SEQ ID NO: 357 - protein, 122 aa, Artificial Sequence
  CD155 v4 IgV
WPPPGTGDVVVQAPTQVPGFLGDSVTLPCYLQVPNMEVTHVSQLTWARHGESGSMVVFHQTQGPSYSESKRLEFVAARLGAELRNASLRMFGLRVEDEGNYTCLFVTFPQGSRSVDIWLRVL

SEQ ID NO: 358 - protein, 122 aa, Artificial Sequence
  CD155 v5 IgV
WPPPGTGDVVVQAPTQVLGFLGDSVTLPCYLQVPNMEVTHVSQLTWARHGESGSMAVFHQTQGPSYSESKRLEFVAARVGAELRNASLRMSGLRVEDEGNYTCLFVTFPQGSRSVDIWLRVL

SEQ ID NO: 359 - protein, 122 aa, Artificial Sequence
  CD155 v6 IgV
WPPPGTGDVVVQAPTQVSGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 360 - protein, 122 aa, Artificial Sequence
  CD155 v7 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 361 - protein, 122 aa, Artificial Sequence
  CD155 v8 IgV
WPPPGTGDVVVQAPTQVTGFLGDSVTLPCYLQVPNMEVTHVPQLTWARHGESGSMAVFHQTQGPSYSESKRLEFVAARLGAELRNASLRMSGLRVEDEGNYTCLFVTFPQGSRSVDIWLRVL

SEQ ID NO: 362 - protein, 122 aa, Artificial Sequence
  CD155 v9 IgV
WPPPGTEDVVVQAPTQVTGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 363 - protein, 122 aa, Artificial Sequence
  CD155 v10 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQDSRSVDIWLRVL

SEQ ID NO: 364 - protein, 122 aa, Artificial Sequence
  CD155 v11 IgV
WPPPGTGDVVVQAPTQVSGFLGDSVTLPCYLQVPNMEVTHVSQLTWARHGESGSMAVFHQTQGPSYSESKRLEFVAARLGAELRNASLRMPGLRVEDEGNYTCLFVTFPQGSRSVDIWLRVL

SEQ ID NO: 365 - protein, 122 aa, Artificial Sequence
  CD155 v12 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTLPQGSRSVDIWLRVL

SEQ ID NO: 366 - protein, 122 aa, Artificial Sequence
  CD155 v14 IgV
WPPPGTGDVVVQAPTQVTGFLGDSVTLPCYLQVPNMEVTHVSQLAWARHGESGSMAVFHQTQGPSYSESKRLEFVAARLGAELRNASLRMSGLRVEDEGNYTCLFVTFPQGSRSVDIWLRVL

SEQ ID NO: 367 - protein, 122 aa, Artificial Sequence
  CD155 v15 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLHVEDEGNYTCLFVTFPQGSRSVDIWLRVL

SEQ ID NO: 368 - protein, 122 aa, Artificial Sequence
  CD155 v16 IgV
WPPPGTGDVVVQAPTQVSGFLGDSVTLPCCLQVPNMEVTHVSQLTWARHGESGSMAVFHQTQGPSYSESKRLEFVAARLGAELRNASLRMSGLRVEDEGNYTCLFVTFPQGSRSVDIWLRVL

SEQ ID NO: 369 - protein, 122 aa, Artificial Sequence
  CD155 v17 IgV
WPPPGTGDVVVQAPTQVPGFLGDSVTLPCYLQVPNMEVTHVSQLTWARHGESGSMAVFHQTQGPSYSESKRLEFVAARLGVEPRNASLRMFGLRVEDEGNYTCLFVTFPQGSRSVDIWLRVL

SEQ ID NO: 370 - protein, 122 aa, Artificial Sequence
  CD155 v18 IgV
WPPPGTGDVVVQAPTQVPGFLGDSVTLPCYLQVPNMEVTHVSQLTWARHGESGSMAVFHQTQGPSYSESKRLEFVAARLGAELRNASPRMFGLRVEDEGNYTCLFVTFPQGSRSVDIWLRVL

SEQ ID NO: 371 - protein, 122 aa, Artificial Sequence
  CD155 v19 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLHVEDEGNYTCLFVTFPQGSRSVDIWLRVL

SEQ ID NO: 372 - protein, 122 aa, Artificial Sequence
  CD155 v20 IgV
WPPPGTGDVVVQEPTQVSGFLGDSVTLPCYLQVPNMEVTHVSQLTWARHGESGSMVVFHQTQGPSYSESKRLEFVAARLGAELRNASLRMSGLRVEDEGNYTCLFVTFPQGSRSVDIWLRVL

SEQ ID NO: 373 - protein, 122 aa, Artificial Sequence
  CD155 v21 IgV
WPPPGTGDVVVQAPTQVTGFLGDSVTLPCYLQVPNMEVTHVSQLTWARHGESGSMAVFHQTQGPSYSESKRLEFVAARLGAELRNASLRMSGLRVEDEGNYTCLFVTFPQGSRSADIWLRVL

SEQ ID NO: 374 - protein, 122 aa, Artificial Sequence
  CD155 v22 IgV
WPPPGTGDVVVQAPTQVTGFLGDSVTLPCYLQVPNMEVTHVSQLTWARHGESGSMAVFHKTQGPSYSESKRLEFVAARLGAELRNASLRMFGLRVEDEGNYTCLFVTFPQGSRSVDIWLRVL

SEQ ID NO: 375 - protein, 323 aa, Artificial Sequence
  CD155 v23 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 376 - protein, 323 aa, Artificial Sequence
  CD155 v24 ECD
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 377 - protein, 323 aa, Artificial Sequence
  CD155 v25 ECD
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 378 - protein, 323 aa, Artificial Sequence
  CD155 v26 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 379 - protein, 323 aa, Artificial Sequence
  CD155 v27 ECD
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 380 - protein, 323 aa, Artificial Sequence
  CD155 v28 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 381 - protein, 323 aa, Artificial Sequence
  CD155 v39 ECD
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 382 - protein, 323 aa, Artificial Sequence
  CD155 v30 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 383 - protein, 323 aa, Artificial Sequence
  CD155 v31 ECD
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 384 - protein, 323 aa, Artificial Sequence
  CD155 v32 ECD
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 385 - protein, 323 aa, Artificial Sequence
  CD155 v33 ECD
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 386 - protein, 323 aa, Artificial Sequence
  CD155 v34 ECD
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 387 - protein, 323 aa, Artificial Sequence
  CD155 v35 ECD
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 388 - protein, 323 aa, Artificial Sequence
  CD155 v36 ECD
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 389 - protein, 323 aa, Artificial Sequence
  CD155 v37 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 390 - protein, 323 aa, Artificial Sequence
  CD155 v38 ECD
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 391 - protein, 323 aa, Artificial Sequence
  CD155 v39 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 392 - protein, 323 aa, Artificial Sequence
  CD155 v40 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 393 - protein, 323 aa, Artificial Sequence
  CD155 v41 ECD
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 394 - protein, 323 aa, Artificial Sequence
  CD155 v42 ECD
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 395 - protein, 323 aa, Artificial Sequence
  CD155 v43 ECD
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 396 - protein, 323 aa, Artificial Sequence
  CD155 v44 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 397 - protein, 323 aa, Artificial Sequence
  CD155 v45 ECD
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 398 - protein, 323 aa, Artificial Sequence
  CD155 v46 ECD
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 399 - protein, 323 aa, Artificial Sequence
  CD155 v47 ECD
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 400 - protein, 323 aa, Artificial Sequence
  CD155 v48 ECD
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 401 - protein, 323 aa, Artificial Sequence
  CD155 v49 ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 402 - protein, 323 aa, Artificial Sequence
  CD155 v50 ECD
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 403 - protein, 323 aa, Artificial Sequence
  CD155 v51 ECD
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 404 - protein, 323 aa, Artificial Sequence
  CD155 v52 ECD
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 405 - protein, 323 aa, Artificial Sequence
  CD155 v53 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 406 - protein, 323 aa, Artificial Sequence
  CD155 v54 ECD
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 407 - protein, 323 aa, Artificial Sequence
  CD155 v55 ECD
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 408 - protein, 323 aa, Artificial Sequence
  CD155 v56 ECD
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 409 - protein, 323 aa, Artificial Sequence
  CD155 v57 ECD
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 410 - protein, 323 aa, Artificial Sequence
  CD155 v58 ECD
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 411 - protein, 323 aa, Artificial Sequence
  CD155 v59 ECD
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 412 - protein, 323 aa, Artificial Sequence
  CD155 v60 ECD
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 413 - protein, 323 aa, Artificial Sequence
  CD155 v61 ECD
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 414 - protein, 323 aa, Artificial Sequence
  CD155 v62 ECD
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 415 - protein, 323 aa, Artificial Sequence
  CD155 v63 ECD
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 416 - protein, 323 aa, Artificial Sequence
  CD155 v64 ECD
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 417 - protein, 323 aa, Artificial Sequence
  CD155 v65 ECD
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 418 - protein, 323 aa, Artificial Sequence
  CD155 v66 ECD
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 419 - protein, 323 aa, Artificial Sequence
  CD155 v67 ECD
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 420 - protein, 323 aa, Artificial Sequence
  CD155 v68 ECD
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 421 - protein, 323 aa, Artificial Sequence
  CD155 v69 ECD
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 422 - protein, 323 aa, Artificial Sequence
  CD155 v70 ECD
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 423 - protein, 323 aa, Artificial Sequence
  CD155 v71 ECD
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 424 - protein, 323 aa, Artificial Sequence
  CD155 v72 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 425 - protein, 323 aa, Artificial Sequence
  CD155 v73 ECD
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 426 - protein, 323 aa, Artificial Sequence
  CD155 v74 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 427 - protein, 323 aa, Artificial Sequence
  CD155 v75 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 428 - protein, 323 aa, Artificial Sequence
  CD155 v76 ECD
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 429 - protein, 323 aa, Artificial Sequence
  CD155 v77 ECD
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 430 - protein, 323 aa, Artificial Sequence
  CD155 v78 ECD
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 431 - protein, 323 aa, Artificial Sequence
  CD155 v79 ECD
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 432 - protein, 323 aa, Artificial Sequence
  CD155 v80 ECD
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 433 - protein, 323 aa, Artificial Sequence
  CD155 v81 ECD
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 434 - protein, 323 aa, Artificial Sequence
  CD155 v82 ECD
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 435 - protein, 323 aa, Artificial Sequence
  CD155 v83 ECD
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 436 - protein, 323 aa, Artificial Sequence
  CD155 v84 ECD
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 437 - protein, 323 aa, Artificial Sequence
  CD155 v85 ECD
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 438 - protein, 323 aa, Artificial Sequence
  CD155 v86 ECD
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 439 - protein, 323 aa, Artificial Sequence
  CD155 v87 ECD
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 440 - protein, 323 aa, Artificial Sequence
  CD155 v88 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 441 - protein, 323 aa, Artificial Sequence
  CD155 v89 ECD
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 442 - protein, 323 aa, Artificial Sequence
  CD155 v90 ECD
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 443 - protein, 323 aa, Artificial Sequence
  CD155 v91 ECD
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 444 - protein, 323 aa, Artificial Sequence
  CD155 v92 ECD
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 445 - protein, 323 aa, Artificial Sequence
  CD155 v94 ECD
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 446 - protein, 323 aa, Artificial Sequence
  CD155 v94 ECD
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 447 - protein, 323 aa, Artificial Sequence
  CD155 v94 ECD
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 448 - protein, 323 aa, Artificial Sequence
  CD155 v96 ECD
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 449 - protein, 323 aa, Artificial Sequence
  CD155 v97 ECD
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 450 - protein, 323 aa, Artificial Sequence
  CD155 v98 ECD
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 451 - protein, 323 aa, Artificial Sequence
  CD155 v99 ECD
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 452 - protein, 323 aa, Artificial Sequence
  CD155 v100 ECD
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 453 - protein, 323 aa, Artificial Sequence
  CD155 v101 ECD
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 454 - protein, 323 aa, Artificial Sequence
  CD155 v102 ECD
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 455 - protein, 323 aa, Artificial Sequence
  CD155 v103 ECD
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 456 - protein, 323 aa, Artificial Sequence
  CD155 v104 ECD
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 457 - protein, 323 aa, Artificial Sequence
  CD155 v105 ECD
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 458 - protein, 323 aa, Artificial Sequence
  CD155 v106 ECD
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 459 - protein, 323 aa, Artificial Sequence
  CD155 v107 ECD
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 460 - protein, 323 aa, Artificial Sequence
  CD155 v108 ECD
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 461 - protein, 323 aa, Artificial Sequence
  CD155 v109 ECD
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 462 - protein, 323 aa, Artificial Sequence
  CD155 v110 ECD
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 463 - protein, 323 aa, Artificial Sequence
  CD155 v111 ECD
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 464 - protein, 323 aa, Artificial Sequence
  CD155 v112 ECD
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 465 - protein, 323 aa, Artificial Sequence
  CD155 v113 ECD
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 466 - protein, 323 aa, Artificial Sequence
  CD155 v114 ECD
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 467 - protein, 323 aa, Artificial Sequence
  CD155 v115 ECD
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 468 - protein, 323 aa, Artificial Sequence
  CD155 v116 ECD
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 469 - protein, 323 aa, Artificial Sequence
  CD155 v117 ECD
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 470 - protein, 323 aa, Artificial Sequence
  CD155 v118 ECD
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 471 - protein, 323 aa, Artificial Sequence
  CD155 v119 ECD
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 472 - protein, 116 aa, Artificial Sequence
  CD155 v23 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWL

SEQ ID NO: 473 - protein, 116 aa, Artificial Sequence
  CD155 v24 IgV
PGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWL

SEQ ID NO: 474 - protein, 116 aa, Artificial Sequence
  CD155 v25 IgV
PGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWL

SEQ ID NO: 475 - protein, 116 aa, Artificial Sequence
  CD155 v26 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWL

SEQ ID NO: 476 - protein, 119 aa, Artificial Sequence
  CD155 v27 IgV
PGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 477 - protein, 116 aa, Artificial Sequence
  CD155 v28 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWL

SEQ ID NO: 478 - protein, 116 aa, Artificial Sequence
  CD155 v29 IgV
PGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWL

SEQ ID NO: 479 - protein, 116 aa, Artificial Sequence
  CD155 v30 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWL

SEQ ID NO: 480 - protein, 116 aa, Artificial Sequence
  CD155 v31 IgV
PGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWL

SEQ ID NO: 481 - protein, 116 aa, Artificial Sequence
  CD155 v32 IgV
PGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWL

SEQ ID NO: 482 - protein, 116 aa, Artificial Sequence
  CD155 v33 IgV
PGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWL

SEQ ID NO: 483 - protein, 116 aa, Artificial Sequence
  CD155 v34 IgV
PGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWL

SEQ ID NO: 484 - protein, 116 aa, Artificial Sequence
  CD155 v35 IgV
PGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWL

SEQ ID NO: 485 - protein, 116 aa, Artificial Sequence
  CD155 v36 IgV
PGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWL

SEQ ID NO: 486 - protein, 116 aa, Artificial Sequence
  CD155 v37 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWL

SEQ ID NO: 487 - protein, 116 aa, Artificial Sequence
  CD155 v38 IgV
PGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWL

SEQ ID NO: 488 - protein, 116 aa, Artificial Sequence
  CD155 v39 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWL

SEQ ID NO: 489 - protein, 116 aa, Artificial Sequence
  CD155 v40 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWL

SEQ ID NO: 490 - protein, 116 aa, Artificial Sequence
  CD155 v41 IgV
PGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWL

SEQ ID NO: 491 - protein, 116 aa, Artificial Sequence
  CD155 v42 IgV
PGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWL

SEQ ID NO: 492 - protein, 116 aa, Artificial Sequence
  CD155 v43 IgV
PGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWL

SEQ ID NO: 493 - protein, 116 aa, Artificial Sequence
  CD155 v44 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWL

SEQ ID NO: 494 - protein, 116 aa, Artificial Sequence
  CD155 v45 IgV
PGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWL

SEQ ID NO: 495 - protein, 116 aa, Artificial Sequence
  CD155 v46 IgV
PGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWL

SEQ ID NO: 496 - protein, 116 aa, Artificial Sequence
  CD155 v47 IgV
PGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWL

SEQ ID NO: 497 - protein, 116 aa, Artificial Sequence
  CD155 v48 IgV
PGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWL

SEQ ID NO: 498 - protein, 116 aa, Artificial Sequence
  CD155 v49 IgV
PGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWL

SEQ ID NO: 499 - protein, 116 aa, Artificial Sequence
  CD155 v50 IgV
PGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWL

SEQ ID NO: 500 - protein, 116 aa, Artificial Sequence
  CD155 v51 IgV
PGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWL

SEQ ID NO: 501 - protein, 116 aa, Artificial Sequence
  CD155 v52 IgV
PGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWL

SEQ ID NO: 502 - protein, 116 aa, Artificial Sequence
  CD155 v53 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWL

SEQ ID NO: 503 - protein, 116 aa, Artificial Sequence
  CD155 v54 IgV
PGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWL

SEQ ID NO: 504 - protein, 116 aa, Artificial Sequence
  CD155 v55 IgV
PGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWL

SEQ ID NO: 505 - protein, 116 aa, Artificial Sequence
  CD155 v56 IgV
PGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWL

SEQ ID NO: 506 - protein, 116 aa, Artificial Sequence
  CD155 v57 IgV
PGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWL

SEQ ID NO: 507 - protein, 116 aa, Artificial Sequence
  CD155 v58 IgV
PGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWL

SEQ ID NO: 508 - protein, 116 aa, Artificial Sequence
  CD155 v59 IgV
PGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWL

SEQ ID NO: 509 - protein, 116 aa, Artificial Sequence
  CD155 v60 IgV
PGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWL

SEQ ID NO: 510 - protein, 116 aa, Artificial Sequence
  CD155 v61 IgV
PGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWL

SEQ ID NO: 511 - protein, 116 aa, Artificial Sequence
  CD155 v62 IgV
PGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWL

SEQ ID NO: 512 - protein, 116 aa, Artificial Sequence
  CD155 v63 IgV
PGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWL

SEQ ID NO: 513 - protein, 116 aa, Artificial Sequence
  CD155 v64 IgV
PGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWL

SEQ ID NO: 514 - protein, 116 aa, Artificial Sequence
  CD155 v65 IgV
PGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWL

SEQ ID NO: 515 - protein, 116 aa, Artificial Sequence
  CD155 v66 IgV
PGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWL

SEQ ID NO: 516 - protein, 116 aa, Artificial Sequence
  CD155 v67 IgV
PGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWL

SEQ ID NO: 517 - protein, 116 aa, Artificial Sequence
  CD155 v68 IgV
PGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWL

SEQ ID NO: 518 - protein, 116 aa, Artificial Sequence
  CD155 v69 IgV
PGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 519 - protein, 116 aa, Artificial Sequence
  CD155 v70 IgV
PGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWL

SEQ ID NO: 520 - protein, 116 aa, Artificial Sequence
  CD155 v71 IgV
PGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWL

SEQ ID NO: 521 - protein, 116 aa, Artificial Sequence
  CD155 v72 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWL

SEQ ID NO: 522 - protein, 116 aa, Artificial Sequence
  CD155 v73 IgV
PGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWL

SEQ ID NO: 523 - protein, 116 aa, Artificial Sequence
  CD155 v74 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 524 - protein, 116 aa, Artificial Sequence
  CD155 v75 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWL

SEQ ID NO: 525 - protein, 116 aa, Artificial Sequence
  CD155 v76 IgV
PGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWL

SEQ ID NO: 526 - protein, 116 aa, Artificial Sequence
  CD155 v77 IgV
PGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWL

SEQ ID NO: 527 - protein, 116 aa, Artificial Sequence
  CD155 v78 IgV
PGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWL

SEQ ID NO: 528 - protein, 116 aa, Artificial Sequence
  CD155 v79 IgV
PGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWL

SEQ ID NO: 529 - protein, 116 aa, Artificial Sequence
  CD155 v80 IgV
PGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWL

SEQ ID NO: 530 - protein, 116 aa, Artificial Sequence
  CD155 v81 IgV
PGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWL

SEQ ID NO: 531 - protein, 116 aa, Artificial Sequence
  CD155 v82 IgV
PGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWL

SEQ ID NO: 532 - protein, 116 aa, Artificial Sequence
  CD155 v83 IgV
PGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWL

SEQ ID NO: 533 - protein, 116 aa, Artificial Sequence
  CD155 v84 IgV
PGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWL

SEQ ID NO: 534 - protein, 116 aa, Artificial Sequence
  CD155 v85 IgV
PGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWL

SEQ ID NO: 535 - protein, 116 aa, Artificial Sequence
  CD155 v86 IgV
PGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWL

SEQ ID NO: 536 - protein, 116 aa, Artificial Sequence
  CD155 v87 IgV
PGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWL

SEQ ID NO: 537 - protein, 116 aa, Artificial Sequence
  CD155 v88 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWL

SEQ ID NO: 538 - protein, 116 aa, Artificial Sequence
  CD155 v89 IgV
PGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWL

SEQ ID NO: 539 - protein, 116 aa, Artificial Sequence
  CD155 v90 IgV
PGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWL

SEQ ID NO: 540 - protein, 116 aa, Artificial Sequence
  CD155 v91 IgV
PGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWL

SEQ ID NO: 541 - protein, 116 aa, Artificial Sequence
  CD155 v92 IgV
PGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWL

SEQ ID NO: 542 - protein, 116 aa, Artificial Sequence
  CD155 v93 IgV
PGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWL

SEQ ID NO: 543 - protein, 116 aa, Artificial Sequence
  CD155 v94 IgV
PGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWL

SEQ ID NO: 544 - protein, 116 aa, Artificial Sequence
  CD155 v95 IgV
PGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWL

SEQ ID NO: 545 - protein, 116 aa, Artificial Sequence
  CD155 v96 IgV
PGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWL

SEQ ID NO: 546 - protein, 116 aa, Artificial Sequence
  CD155 v97 IgV
PGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWL

SEQ ID NO: 547 - protein, 116 aa, Artificial Sequence
  CD155 v98 IgV
PGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWL

SEQ ID NO: 548 - protein, 116 aa, Artificial Sequence
  CD155 v99 IgV
PGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWL

SEQ ID NO: 549 - protein, 116 aa, Artificial Sequence
  CD155 v100 IgV
PGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWL

SEQ ID NO: 550 - protein, 116 aa, Artificial Sequence
  CD155 v101 IgV
PGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWL

SEQ ID NO: 551 - protein, 116 aa, Artificial Sequence
  CD155 v102 IgV
PGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWL

SEQ ID NO: 552 - protein, 116 aa, Artificial Sequence
  CD155 v103 IgV
PGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWL

SEQ ID NO: 553 - protein, 116 aa, Artificial Sequence
  CD155 v104 IgV
PGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWL

SEQ ID NO: 554 - protein, 116 aa, Artificial Sequence
  CD155 v105 IgV
PGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWL

SEQ ID NO: 555 - protein, 116 aa, Artificial Sequence
  CD155 v106 IgV
PGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWL

SEQ ID NO: 556 - protein, 116 aa, Artificial Sequence
  CD155 v107 IgV
PGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWL

SEQ ID NO: 557 - protein, 116 aa, Artificial Sequence
  CD155 v108 IgV
PGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWL

SEQ ID NO: 558 - protein, 116 aa, Artificial Sequence
  CD155 v109 IgV
PGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWL

SEQ ID NO: 559 - protein, 116 aa, Artificial Sequence
  CD155 v110 IgV
PGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWL

SEQ ID NO: 560 - protein, 116 aa, Artificial Sequence
  CD155 v111 IgV
PGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWL

SEQ ID NO: 561 - protein, 116 aa, Artificial Sequence
  CD155 v112 IgV
PGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWL

SEQ ID NO: 562 - protein, 116 aa, Artificial Sequence
  CD155 v113 IgV
PGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWL

SEQ ID NO: 563 - protein, 116 aa, Artificial Sequence
  CD155 v114 IgV
PGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWL

SEQ ID NO: 564 - protein, 116 aa, Artificial Sequence
  CD155 v115 IgV
PGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWL

SEQ ID NO: 565 - protein, 116 aa, Artificial Sequence
  CD155 v116 IgV
PGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWL

SEQ ID NO: 566 - protein, 116 aa, Artificial Sequence
  CD155 v117 IgV
PGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWL

SEQ ID NO: 567 - protein, 116 aa, Artificial Sequence
  CD155 v118 IgV
PGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWL

SEQ ID NO: 568 - protein, 116 aa, Artificial Sequence
  CD155 v119 IgV
PGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWL

SEQ ID NO: 569 - protein, 122 aa, Artificial Sequence
  CD155 v23 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCLFVTFPQGSRSVDIWLRVL

SEQ ID NO: 570 - protein, 122 aa, Artificial Sequence
  CD155 v24 IgV
WPPPGTGDVVVQAPTQVPGFLGDSVTLPCYLQVPNMEVTHVSQLQWARHGELGSMAVFHQTQGPSYSESKRLEFVAARLGAELRNASLRMFGLRVEDEGNYTCEFVTFPQRSRSVDIWLRVL

SEQ ID NO: 571 - protein, 122 aa, Artificial Sequence
  CD155 v25 IgV
WPPPGTGDVVVQAPTQVPGFLGDSVTLPCYLQVPNMEVTHVGQLTWARHGESGSMAVFHQTQGPSYSESKRLEFVAARLGAELRNASLRMFGLRVEDEGNYTCLFVTFPQGSRSVDIWLRVL

SEQ ID NO: 572 - protein, 122 aa, Artificial Sequence
  CD155 v26 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCLFVTFPQGSRSVDIWLRVL

SEQ ID NO: 573 - protein, 122 aa, Artificial Sequence
  CD155 v27 IgV
WPPPGTGDVVVQAPTQVPGFLGDSVTLPCYLQVPNMEVTHVSQLTWARHGEQGSMAVFHQTQGPSYSESKRLEFVAARLGAELRNASLRMFGLRVEDEGNYTCLFVTFPQGSRSVDIWLRVL

SEQ ID NO: 574 - protein, 122 aa, Artificial Sequence
  CD155 v28 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCQFVTFPQRSRSVDIWLRVL

SEQ ID NO: 575 - protein, 122 aa, Artificial Sequence
  CD155 v29 IgV
WPPPGTGDVVVQAPTQVPGFLGDSVTLPCYLQVPNMEVTHVAQLTWARHGEQGSMAVFHQTQGPSYSESKRLEFVAARLGAELRNASLRMFGLRVEDEGNYTCQFVTFPQRSRSVDIWLRVL

SEQ ID NO: 576 - protein, 122 aa, Artificial Sequence
  CD155 v30 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCEFVTFPQGSRSVDIWLRVL

SEQ ID NO: 577 - protein, 122 aa, Artificial Sequence
  CD155 v31 IgV
WPPPGTGDVVVQAPTQVPGFLGDSVTLPCYLQVPNMEVTHVCQLTWARHGESGSMAVFHQTQGPSYSESKRLEFVAARLGAELRNASLRMFGLRVEDEGNYTCLFVTFPQGSRSVDIWLRVL

SEQ ID NO: 578 - protein, 122 aa, Artificial Sequence
  CD155 v32 IgV
WPPPGTGDVVVQAPTQVPGFLGDSVTLPCYLQVPNMEVTHVSQLTWARHGEWGSMAVFHQTQGPSYSESKRLEFVAARLGAELRNASLRMFGLRVEDEGNYTCLFVTFPQGSRSVDIWLRVL

SEQ ID NO: 579 - protein, 122 aa, Artificial Sequence
  CD155 v33 IgV
WPPPGTGDVVVQAPTQVPGFLGDSVTLPCYLQVPNMEVTHVSQLTWARHGEMGSMAVFHQTQGPSYSESKRLEFVAARLGAELRNASLRMFGLRVEDEGNYTCQFVTFPQGSRSVDIWLRVL

SEQ ID NO: 580 - protein, 122 aa, Artificial Sequence
  CD155 v34 IgV
WPPPGTGDVVVQAPTQVPGFLGDSVTLPCYLQVPNMEVTHVLQLTWARHGELGSMAVFHQTFGPSYSESKRLEFVAARLGAELRNASLRMFGLRVEDEGNYTCQFVTFPQGSRSVDIWLRVL

SEQ ID NO: 581 - protein, 122 aa, Artificial Sequence
  CD155 v35 IgV
WPPPGTGDVVVQAPTQVPGFLGDSVTLPCYLQVPNMEVTHVWQLTWARHGESGSMAVFHQTQGPSYSESKRLEFVAARLGAELRNASLRMFGLRVEDEGNYTCLFVTFPQGSRSVDIWLRVL

SEQ ID NO: 582 - protein, 122 aa, Artificial Sequence
  CD155 v36 IgV
WPPPGTGDVVVQAPTQVPGFLGDSVTLPCYLQVPNMEVTHVQQLTWARHGESGSMAVFHQTQGPSYSESKRLEFVAARLGAELRNASLRMFGLRVEDEGNYTCLFVTFPQGSRSVDIWLRVL

SEQ ID NO: 583 - protein, 122 aa, Artificial Sequence
  CD155 v37 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCLFVTFPQGSRSVDIWLRVL

SEQ ID NO: 584 - protein, 122 aa, Artificial Sequence
  CD155 v38 IgV
WPPPGTGDVVVQAPTQVPGFLGDSVTLPCYLQVPNMEVTHVSQLTWARHGERGSMAVFHQTQGPSYSESKRLEFVAARLGAELRNASLRMFGLRVEDEGNYTCLFVTFPQGSRSVDIWLRVL

SEQ ID NO: 585 - protein, 122 aa, Artificial Sequence
  CD155 v39 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCEFVTFPQGSRSVDIWLRVL

SEQ ID NO: 586 - protein, 122 aa, Artificial Sequence
  CD155 v40 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQRSRSVDIWLRVL

SEQ ID NO: 587 - protein, 122 aa, Artificial Sequence
  CD155 v41 IgV
WPPPGTGDVVVQAPTQVPGFLGDSVTLPCYLQVPNMEVTHVSQLTWARHGEEGSMAVFHQTQGPSYSESKRLEFVAARLGAELRNASLRMFGLRVEDEGNYTCLFVTFPQGSRSVDIWLRVL

SEQ ID NO: 588 - protein, 122 aa, Artificial Sequence
  CD155 v42 IgV
WPPPGTGDVVVQAPTQVPGFLGDSVTLPCYLQVPNMEVTHVSQLTWARHGESGSMAVFHQTYGPSYSESKRLEFVAARLGAELRNASLRMFGLRVEDEGNYTCLFVTFPQGSRSVDIWLRVL

SEQ ID NO: 589 - protein, 122 aa, Artificial Sequence
  CD155 v43 IgV
WPPPGTGDVVVQAPTQVPGFLGDSVTLPCYLQVPNMEVTHVSQLQWARHGEMGSMAVFHQTQGPSYSESKRLEFVAARLGAELRNASLRMFGLRVEDEGNYTCEFVTFPQGSRSVDIWLRVL

SEQ ID NO: 590 - protein, 122 aa, Artificial Sequence
  CD155 v44 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCQFVTFPQRSRSVDIWLRVL

SEQ ID NO: 591 - protein, 122 aa, Artificial Sequence
  CD155 v45 IgV
WPPPGTGDVVVQAPTQVPGFLGDSVTLPCYLQVPNMEVTHVSQLTWARHGEMGSMALFHQTQGPSYSESKRLEFVAARLGAELRNASLRMFGLRVEDEGNYTCLFVTFPQGSRSVDIWLRVL

SEQ ID NO: 592 - protein, 122 aa, Artificial Sequence
  CD155 v46 IgV
WPPPGTGDVVVQAPTQVPGFLGDSVTLPCYLQVPNMEVTHVNQLTWARHGEQGSMAVFHQTFGPSYSESKRLEFVAARLGAELRNASLRMFGLRVEDEGNYTCLFVTFPQGSRSVDIWLRVL

SEQ ID NO: 593 - protein, 122 aa, Artificial Sequence
  CD155 v47 IgV
WPPPGTGDVVVQAPTQVPGFLGDSVTLPCYLQVPNMEVTHVAQLTWARHGELGSMAVFHQTQGPSYSESKRLEFVAARLGAELRNASLRMFGLRVEDEGNYTCEFVTFPQRSRSVDIWLRVL

SEQ ID NO: 594 - protein, 122 aa, Artificial Sequence
  CD155 v48 IgV
WPPPGTGDVVVQAPTQVPGFLGDSVTLPCYLQVPNMEVTHVWQLTWARHGEQGSMALFHQTYGPSYSESKRLEFVAARLGAELRNASLRMFGLRVEDEGNYTCLFVTFPQGSRSVDIWLRVL

SEQ ID NO: 595 - protein, 122 aa, Artificial Sequence
  CD155 v49 IgV
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCQFVTFPQGSRSVDIWLRVL

SEQ ID NO: 596 - protein, 122 aa, Artificial Sequence
  CD155 v50 IgV
WPPPGTGDVVVQAPTQVPGFLGDSVTLPCYLQVPNMEVTHVLQLTWARHGEQGSMAVFHQTQGPSYSESKRLEFVAARLGAELRNASLRMFGLRVEDEGNYTCEFVTFPQGSRSVDIWLRVL

SEQ ID NO: 597 - protein, 122 aa, Artificial Sequence
  CD155 v51 IgV
WPPPGTGDVVVQAPTQVPGFLGDSVTLPCYLQVPNMEVTHVCQLTWARHGELGSMAVFHQTQGPSYSESKRLEFVAARLGAELRNASLRMFGLRVEDEGNYTCLFVTFPQGSRSVDIWLRVL

SEQ ID NO: 598 - protein, 122 aa, Artificial Sequence
  CD155 v52 IgV
WPPPGTGDVVVQAPTQVPGFLGDSVTLPCYLQVPNMEVTHVWQLTWARHGERGSMAVFHQTYGPSYSESKRLEFVAARLGAELRNASLRMFGLRVEDEGNYTCQFVTFPQGSRSVDIWLRVL

SEQ ID NO: 599 - protein, 122 aa, Artificial Sequence
  CD155 v53 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCEFVTFPQGSRSVDIWLRVL

SEQ ID NO: 600 - protein, 122 aa, Artificial Sequence
  CD155 v54 IgV
WPPPGTGDVVVQAPTQVPGFLGDSVTLPCYLQVPNMEVTHVSQLTWARHGERGSMAVFHQTFGPSYSESKRLEFVAARLGAELRNASLRMFGLRVEDEGNYTCQFVTFPQRSRSVDIWLRVL

SEQ ID NO: 601 - protein, 122 aa, Artificial Sequence
  CD155 v55 IgV
WPPPGTGDVVVQAPTQVPGFLGDSVTLPCYLQVPNMEVTHVSQLQWARHGELGSMALFHQTQGPSYSESKRLEFVAARLGAELRNASLRMFGLRVEDEGNYTCEFVTFPQGSRSVDIWLRVL

SEQ ID NO: 602 - protein, 122 aa, Artificial Sequence
  CD155 v56 IgV
WPPPGTGDVVVQAPTQVPGFLGDSVTLPCYLQVPNMEVTHVSQLTWARHGEMGSMAVFHQTYGPSYSESKRLEFVAARLGAELRNASLRMFGLRVEDEGNYTCLFVTFPQGSRSVDIWLRVL

SEQ ID NO: 603 - protein, 122 aa, Artificial Sequence
  CD155 v57 IgV
WPPPGTGDVVVQAPTQVPGFLGDSVTLPCYLQVPNMEVTHVSQLTWARHGESGSMAVFHQTFGPSYSESKRLEFVAARLGAELRNASLRMFGLRVEDEGNYTCEFVTFPQRSRSVDIWLRVL

SEQ ID NO: 604 - protein, 122 aa, Artificial Sequence
  CD155 v58 IgV
WPPPGTGDVVVQAPTQVPGFLGDSVTLPCYLQVPNMEVTHVSQLQWARHGEQGSMAVFHQTQGPSYSESKRLEFVAARLGAELRNASLRMFGLRVEDEGNYTCLFVTFPQGSRSVDIWLRVL

SEQ ID NO: 605 - protein, 122 aa, Artificial Sequence
  CD155 v59 IgV
WPPPGTGDVVVQAPTQVPGFLGDSVTLPCYLQVPNMEVTHVSQLTWARHGELGSMAVFHQTQGPSYSESKRLEFVAARLGAELRNASLRMFGLRVEDEGNYTCEFVTFPQGSRSVDIWLRVL

SEQ ID NO: 606 - protein, 122 aa, Artificial Sequence
  CD155 v60 IgV
WPPPGTGDVVVQAPTQVPGFLGDSVTLPCYLQVPNMEVTHVVQLTWARHGEEGSMAVFHQTQGPSYSESKRLEFVAARLGAELRNASLRMFGLRVEDEGNYTCLFVTFPQGSRSVDIWLRVL

SEQ ID NO: 607 - protein, 122 aa, Artificial Sequence
  CD155 v61 IgV
WPPPGTGDVVVQAPTQVPGFLGDSVTLPCYLQVPNMEVTHVSQLQWARHGERGSMAVFHQTQGPSYSESKRLEFVAARLGAELRNASLRMFGLRVEDEGNYTCLFVTFPQRSRSVDIWLRVL

SEQ ID NO: 608 - protein, 122 aa, Artificial Sequence
  CD155 v62 IgV
WPPPGTGDVVVQAPTQVPGFLGDSVTLPCYLQVPNMEVTHVGQLTWARHGEQGSMAVFHQTQGPSYSESKRLEFVAARLGAELRNASLRMFGLRVEDEGNYTCEFVTFPQRSRSVDIWLRVL

SEQ ID NO: 609 - protein, 122 aa, Artificial Sequence
  CD155 v63 IgV
WPPPGTGDVVVQAPTQVPGFLGDSVTLPCYLQVPNMEVTHVNQLTWARHGEEGSMALFHQTQGPSYSESKRLEFVAARLGAELRNASLRMFGLRVEDEGNYTCEFVTFPQGSRSVDIWLRVL

SEQ ID NO: 610 - protein, 122 aa, Artificial Sequence
  CD155 v64 IgV
WPPPGTGDVVVQAPTQVPGFLGDSVTLPCYLQVPNMEVTHVCQLTWARHGEMGSMAVFHQTFGPSYSESKRLEFVAARLGAELRNASLRMFGLRVEDEGNYTCLFVTFPQGSRSVDIWLRVL

SEQ ID NO: 611 - protein, 122 aa, Artificial Sequence
  CD155 v65 IgV
WPPPGTGDVVVQAPTQVPGFLGDSVTLPCYLQVPNMEVTHVLQLTWARHGESGSMAVFHQTQGPSYSESKRLEFVAARLGAELRNASLRMFGLRVEDEGNYTCLFVTFPQGSRSVDIWLRVL

SEQ ID NO: 612 - protein, 122 aa, Artificial Sequence
  CD155 v66 IgV
WPPPGTGDVVVQAPTQVPGFLGDSVTLPCYLQVPNMEVTHVAQLTWARHGESGSMAVFHQTQGPSYSESKRLEFVAARLGAELRNASLRMFGLRVEDEGNYTCLFVTFPQGSRSVDIWLRVL

SEQ ID NO: 613 - protein, 122 aa, Artificial Sequence
  CD155 v67 IgV
WPPPGTGDVVVQAPTQVPGFLGDSVTLPCYLQVPNMEVTHVGQLTWARHGELGSMAVFHQTFGPSYSESKRLEFVAARLGAELRNASLRMFGLRVEDEGNYTCQFVTFPQGSRSVDIWLRVL

SEQ ID NO: 614 - protein, 122 aa, Artificial Sequence
  CD155 v68 IgV
WPPPGTGDVVVQAPTQVPGFLGDSVTLPCYLQVPNMEVTHVNQLTWARHGESGSMAVFHQTQGPSYSESKRLEFVAARLGAELRNASLRMFGLRVEDEGNYTCLFVTFPQGSRSVDIWLRVL

SEQ ID NO: 615 - protein, 122 aa, Artificial Sequence
  CD155 v69 IgV
WPPPGTGDVVVQAPTQVTGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 616 - protein, 122 aa, Artificial Sequence
  CD155 v70 IgV
WPPPGTGDVVVQAPTQVFGFLGDSVTLPCYLQVPNMEVAHVSQLQWARHGESGSMAVFHQRQGPNYLESKRLGFVAAGLGAELRNASLRMFGLRVEDEGNYTCLFVTFPQGSRSVDIWLRVL

SEQ ID NO: 617 - protein, 122 aa, Artificial Sequence
  CD155 v71 IgV
WPPPGTGDVVVQAPTQVTGFLGDSVTLPCYLQVPNMEVTHVSQLQWARHGESGSMAVFHQRQGPNYLESKRLEFVAARLGAELRNASLRMFGLRVEDEGNYTCLFVTFPQGSRSVDIWLRVL

SEQ ID NO: 618 - protein, 122 aa, Artificial Sequence
  CD155 v72 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCLFVTFPQGSRSVDIWLRVL

SEQ ID NO: 619 - protein, 122 aa, Artificial Sequence
  CD155 v73 IgV
WPPPGTGDVVVQAPTQVFGFLGDSVTLPCYLQVPNMEVTHVSQLQWARHGESGSMAVFHQRQGPNYLESKRLEFVAARLGAELRNASLRMSGLRVEDEGNYTCPFVTFPQGSRSVDIWLRVL

SEQ ID NO: 620 - protein, 122 aa, Artificial Sequence
  CD155 v74 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 621 - protein, 122 aa, Artificial Sequence
  CD155 v75 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCMFVTFPQGSRSVDIWLRVL

SEQ ID NO: 622 - protein, 122 aa, Artificial Sequence
  CD155 v76 IgV
WPPPGTGDVVVQAPTQVPGFLGDSVTLPCYLQVPNMEVTHVSQLTWARHGESGSMAVFHQTQGPSYSESKRLEFVAARPGAELRNASLRMFGLRVEDEGNYTCMFVTFPQGSRSVDIWLRVL

SEQ ID NO: 623 - protein, 122 aa, Artificial Sequence
  CD155 v77 IgV
WPPPGTGDVVVQAPTQVTGFLGDSVTLPCYLQVPNMEVTHVSQLQWARHGESGSMAVFHQTQGPSYSESKRLEFVAARPGAELRNASLRMFGLRVEDEGNYTCLFVTFPQGSRSVDIWLRVL

SEQ ID NO: 624 - protein, 122 aa, Artificial Sequence
  CD155 v78 IgV
WPPPGTGDVVVQAPTQVTGFLGDSVTLPCYLQVPNMEVTHVSQLQWARHGESGSMAVFHQRQGPHYHESKRLEFVAARLGAELRNASLRMFGLRVEDEGNYTCLFVTFPQGSRSVDIWLRVL

SEQ ID NO: 625 - protein, 122 aa, Artificial Sequence
  CD155 v79 IgV
WPPPGTGDVVVQAPTQVTGFLGDSVTLPCYLQVPNMEVTHVSQLTWARHGESGSMAVFHQTQGPSYSESKRLEFVAARLGEELRNASLRMFGLRVEDEGNYTCLFVTFPQGSRSVDIWLRVL

SEQ ID NO: 626 - protein, 122 aa, Artificial Sequence
  CD155 v80 IgV
WPPPGTGDVVVQAPTQVSGFLGYSVTLPCYLQVPNMPVTHVSQLTWARHGEGGSMAVFHQTMGPSYSESKRLEFVAARLSPELRNASLRMFGLRVEDEYNYTCLFVTFPQGNRSVDIWLRVL

SEQ ID NO: 627 - protein, 122 aa, Artificial Sequence
  CD155 v81 IgV
WPPPGTGDVVVQRPTQVPGFLGYSVTLPCYLQVPNMPVTHVPQLTWARHGESGSMAVFHQTYGPSYSESKRLEFVAARLGEELRNASLRMFGLRVEDEGNYTCLFVTFPQGSRSVDIWLRVL

SEQ ID NO: 628 - protein, 122 aa, Artificial Sequence
  CD155 v82 IgV
WPPPGTGDVVVQRPTQVPGFLGYSVTLPCYLQVPNMPVTHVSQLTWARHGESGSMAVFHQTQGPSYSESKRLEFVAARLGAELRNASLRMFGLRVEDEYNYTCLFVTFPQGNRSVDIWLRVL

SEQ ID NO: 629 - protein, 122 aa, Artificial Sequence
  CD155 v83 IgV
WPPPGTGDVVVQRPTQVPGFLGYSVTLPCYLQVPNMPVTHVSQLTWARHGESGSMAVFHQTMGPSYSESKRLEFVAVRLSPELRNASLRMFGLRVEDEYNYTCLFVTFPQGSRSVDIWLRVL

SEQ ID NO: 630 - protein, 122 aa, Artificial Sequence
  CD155 v84 IgV
WPPPGTGDVVVQAPTQVLGFLGDSVTLPCYLQVPNMSVTHVSQLTWARHGESGSMAVFHQTMGPSYSESKRLEFVAARLSPELRNASLRMFGLRVEDEYNYTCLFVTFPQGNRSVDIWLRVL

SEQ ID NO: 631 - protein, 122 aa, Artificial Sequence
  CD155 v85 IgV
WPPPGTGDVVVQAPTQVSGFLGDSVTLPCYLQVPNMEVTHVSQLTWARHGESGSMAVFHQTQGPSYSESKRLEFVAARLGAELRNASLRMFGLRVEDEGNYTCTFVTFPQGSRSVDIWLRVL

SEQ ID NO: 632 - protein, 122 aa, Artificial Sequence
  CD155 v86 IgV
WPPPGTGDVVVQAPTQVSGFLGDSVTLPCYLQVPNMEVTHVSQLTWARHGESGSMAVFHQTHGPSYSESKRLEFVAARQGAELRNASLRMSGLRVEDEGNYTCLFVTFPQGSRSVDIWLRVL

SEQ ID NO: 633 - protein, 122 aa, Artificial Sequence
  CD155 v87 IgV
WPPPGTGDVVVQAPTQVPGFLGDSVTLPCYLQVPNMEVTHVSQLQWARHGEKGSMAVFHQTFGPSYSESKRLEFVAARLGAELRNASLRMFGLRVEDEGNYTCQFVTFPQRSRSVDIWLRVL

SEQ ID NO: 634 - protein, 122 aa, Artificial Sequence
  CD155 v88 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCQFVTFPQRSRSVDIWLRVL

SEQ ID NO: 635 - protein, 122 aa, Artificial Sequence
  CD155 v89 IgV
WPPPGTGDVVVQAPTQVPGFLGDSVTLPCYLQVPNMEVTHVSQLQWARHGEQGSMAVFHQTYGPSYSESKRLEFVAARLGAELRNASLRMFGLRVEDEGNYTCEFVTFPQRSRSVDIWLRVL

SEQ ID NO: 636 - protein, 122 aa, Artificial Sequence
  CD155 v90 IgV
WPPPGTGDVVVQAPTQVPGFLGDSVTLPCYLQVPNMEVTHVSQLTWARHGESGSMAAFHQMQGPWYAESKRLEFVAARLGAELRNASLRMFGLRVDDEGNYTCTFVTFPQGSRSVDIWLRVL

SEQ ID NO: 637 - protein, 122 aa, Artificial Sequence
  CD155 v91 IgV
WPPPGTGDVVVQAPTQVLGFLGDSVTLPCYLQVPNMEVTHVSQLTWARHGESGSMATFHQSQGPYYAESKRLEFVAARLGAELRNASLRMFGLRVEDEGNYTCTFVTFPQGSRSVDIWLRVL

SEQ ID NO: 638 - protein, 122 aa, Artificial Sequence
  CD155 v92 IgV
WPPPGTGDVVVQAPTQVTGFLGDSVTLPCYLQVPNMEVTHVSQLQWARHGESGSMAVFHQTQGPSYSESKRLEFVAARLGAELRNASLRMFGLRVEDEGNYTCLFVTFPQGSRSVDIWLRVL

SEQ ID NO: 639 - protein, 122 aa, Artificial Sequence
  CD155 v93 IgV
WPPPGTGDVVVQAPTQVLGFLGDSVTLPCYLQVPNMEVTHVSQLTWARHGESGSMAAFHQMQGPWYAESKRLEFVAARLGAELRNASLRMFGLRVEDEGNYTCTFVTFPQGSRSVDIWLRVL

SEQ ID NO: 640 - protein, 122 aa, Artificial Sequence
  CD155 v94 IgV
WPPPGTGDVVVQAPTQVPGFLGDSVTLPCYLQVPNMEVTHVSQLTWARHGESGSMAVFHQMQGPWYAESKRLEFVAARLGAELRNASLRMFGLRVEDEGNYTCTFVTFPQGSRSVDIWLRVL

SEQ ID NO: 641 - protein, 122 aa, Artificial Sequence
  CD155 v95 IgV
WPPPGTGDVVVQAPTQVSGFLGDSVTLPCYLQVPNMEVTHAGQLGWARHGESGSMAVFHQTQGPSYSESKRLEFVAARLGAELRNASLRMFGLRVEDEGNYTCNFVTFPQGSRSVDIWLRVL

SEQ ID NO: 642 - protein, 122 aa, Artificial Sequence
  CD155 v96 IgV
WPPPGTGDVVVQAPTQVHGFLGDSVTLPCYLQVPNMEVTHVGQLIWARHGETRHMALFEQSQGPDYSGSKRLEFVAARLGAELRNASLRMFGLRVEDEGNYTCNFVTFPQGSRSVDIWLRVL

SEQ ID NO: 643 - protein, 122 aa, Artificial Sequence
  CD155 v97 IgV
WPPPGTGDVVVQAPTQVSGFLGDSVTLPCYLQVPNMEVTHVGQLVWARHGESGSMAVLHQTQGPSYWESKRLEFVAARLGAELRNASLRMFGLRVEDEGNYTCNFVTFPQGSRSVDIWLRVL

SEQ ID NO: 644 - protein, 122 aa, Artificial Sequence
  CD155 v98 IgV
WPPPGTGDVVVQAPTQVSGFLGDSVTLPCYLQVPNMEVTHVSQLIWARHGESGSMAVFHQTQGPSYSESKRLEFVAARLGAELRNASLRMFGLRVEDEGNYTCNFVTFPQGSRSVDIWLRVL

SEQ ID NO: 645 - protein, 122 aa, Artificial Sequence
  CD155 v99 IgV
WPPPGTGDVVVQAPTQVSGFLGDSVTLPCYLQVPNMEVTHVGQLGWARHGESGSMAVFHQTQGPSYSESKRLEFVAARLGAELRNASLRMFGLRVEDEGNYTCNFATFPQGSRSVDIWLRVL

SEQ ID NO: 646 - protein, 122 aa, Artificial Sequence
  CD155 v100 IgV
WPPPGTGDVVVQAPTQVHGFLGDSVTLPCYLQVPNMEVTRVGQLIWARHGETRHMALFEQSQGPDYSGSKRLEFVAARLGAELRNASLRMFGLRVEDEGNYTCYFLTHPQGSRSVDIWLRVL

SEQ ID NO: 647 - protein, 122 aa, Artificial Sequence
  CD155 v101 IgV
WPPPGTGDVVVQAPTQVPGFLGDSVTLPCYLQVPNMVVTHVGQLGWARHGESGSMAVFHQTQGPSYSESKRLEFVAARLGAELRNASLRMFGLRVEDEGNYTCNFVTFPQGSRSVDIWLRVL

SEQ ID NO: 648 - protein, 122 aa, Artificial Sequence
  CD155 v102 IgV
WPPPGTGDVVVQAPTQVSGFLGDSVTLPCYLQVPNMEVTHVSQLQWARHGESGSMAVFHQTQGPSYSESKRLEFVAARPGAELRNASLRMFGLRVEDEGNYTCTFVTFPQGSRSVDIWLRVL

SEQ ID NO: 649 - protein, 122 aa, Artificial Sequence
  CD155 v103 IgV
WPPPGTGDVVVQAPTQVLGFLGDSVTLPCYLQVPNMEVTHVSQLTWARHGESGSMAVFHQTRGPSYSESKRLEFVAARLGAELRNASLRMFGLRVEDEGNYTCLFVTFPQGSRSVDIWLRVL

SEQ ID NO: 650 - protein, 122 aa, Artificial Sequence
  CD155 v104 IgV
WPPPGTGDVVVQRPTQVPGFLGYSVTLPCYLQVPNMPVTHVLQLTWARHGEGGSMAVFHQTYGPSYSESKRLEFVAARLGEELRNASLRMFGLRVEDEGNYTCLFVTFPQGSRSVDIWLRVL

SEQ ID NO: 651 - protein, 122 aa, Artificial Sequence
  CD155 v105 IgV
WPPPGTGDVVVQAPTQVLGFLGDSVTLPCYLQVPNMEVTHVSQLTWARRGESGSMAVFHQTQGPSYSESKRLEFVAARLGAELRNASLRMFGLRVEDEGNYTCTFVTFPQGSRSVNIWLRVL

SEQ ID NO: 652 - protein, 122 aa, Artificial Sequence
  CD155 v106 IgV
WPPPGTGDVVVQRPTQVPGFLGYSVTLPCYLQVPNMPVTHVSQLTWARHGESGSMAVFHQTMGPSYSESKRLEFVAARLSPELRNASLRMFGLRVEDEGNYTCTFVTFPQGSRSVDIWLRVL

SEQ ID NO: 653 - protein, 122 aa, Artificial Sequence
  CD155 v107 IgV
WPPPGTGDVVVQAPTQVPGFLGDSVTLPCYLQVPNMEVTHVSQLTWARHGESGSMAVFHQTQGPTYSESKRLEFVAARLGAELRNASLRMFGLRVEDEGNYTCTFVTFPQGSRSVDIWLRVL

SEQ ID NO: 654 - protein, 122 aa, Artificial Sequence
  CD155 v108 IgV
WPPPGTGDVVVQRPTQVPGFLGYSVTLPCYLQVPNMPVTHVSQLTWARHGEGGSMAAFHQTMGPSYSESERLEFVAARLGAELRNASLRMFGLRVEDEGNYTCTFVTFPQGSRSVDIWLRVL

SEQ ID NO: 655 - protein, 122 aa, Artificial Sequence
  CD155 v109 IgV
WPPPGTGDVVVQAPTQVLGFLGDSVTLPCYLQVPNMEVTHVSQLTWVRHGESGSMAVFHQTYGPSYSESKRLDFVAARLGAELRNASLRMFGLRVEDEGNYTCTFVTFPQGSRSVDIWLRVL

SEQ ID NO: 656 - protein, 122 aa, Artificial Sequence
  CD155 v110 IgV
WPPPGTGDVVVQAPTQVPGFLGDSVTLPCYLQVPNMEVTTMSQLTWVRHGEQGSMAVFHQTLGPTYSESKRLRFVAARLGAELRNASLRMFGLRVEGSGNYTCTFVTFPQGSRSVNIWLRVL

SEQ ID NO: 657 - protein, 122 aa, Artificial Sequence
  CD155 v111 IgV
WPPPGTGDVVVQAPTQVLGFLGDSVTLPCYLQVPNMEVTHVPQLQWARHGESGSMAVFHQGQGPHYEESKRLEFVAARLGAELRNASLRMFGLRVEDEGNYTCTFVTFPQGSRSVNIWLRVL

SEQ ID NO: 658 - protein, 122 aa, Artificial Sequence
  CD155 v112 IgV
WPPPGTGDVVVQAPTQVSGFLGDSVTLPCYLQVPNMEVTTMSQLTWVRHGEQGSMAVFHQTLGPTYSESKRLRFVAARLGAELRNASLRMFGLRVEDEGNYTCMFATFPQGSRSVDIWLRVL

SEQ ID NO: 659 - protein, 122 aa, Artificial Sequence
  CD155 v113 IgV
WPPPGTGDVVVQAPTQVPGFLGDSVTLPCYLQVPNMEVTTMSQLTWVRHGEQGSMAVFHQTLGPTYSGSKRLRFVAARLGAELRNASLRMFGLRVEGSGNYTCTFVTFPQGSRSVDIWLRVL

SEQ ID NO: 660 - protein, 122 aa, Artificial Sequence
  CD155 v114 IgV
WPPPGTGDVVVQAPTQVPGFLGDSVTLPCYLQVPNMEVTHVSQLQWARHGEEGSMAVFHQTQGPSYSESKRLEFVAARLGAELRNASLRMFGLRVEDEGNYTCEFVTFPQGSRSVDIWLRVL

SEQ ID NO: 661 - protein, 122 aa, Artificial Sequence
  CD155 v115 IgV
WPPPGTGDVVVQAPTQVPGFLGDSVTLPCYLQVPNMEVTHVSQLQWARHGEEGSMAVFHQTFGPSYSESKRLEFVAARLGAELRNASLRMFGLRVEDEGNYTCEFVTFPQGSRSVDIWLRVL

SEQ ID NO: 662 - protein, 122 aa, Artificial Sequence
  CD155 v116 IgV
WPPPGTGDVVVQAPTQVFGFLGDSVMLPCYLQVPNMEVTHVSQVTWARHGESGSMAVFHQTKGPSYSESKRLEFVAARPGAELRNASLRMSGLRVEDEGNYTCMFVTFPQDSRSVDIWLRVL

SEQ ID NO: 663 - protein, 122 aa, Artificial Sequence
  CD155 v117 IgV
WPPPGTGDVVVQAPTQVSGFLGDSVTLPCYLQVPNMEVTHVSQLSWARHGESGSMAVFHQKQGPWYAESKRLEFVAARLGAELRNASLRMSGLRVEDEGNYTCLFVTFPQRSRSVDIWLRVL

SEQ ID NO: 664 - protein, 122 aa, Artificial Sequence
  CD155 v118 IgV
WPPPGTGDVVVQAPTQVSGFLGDSVTLPCYLQVPNMEVTHVSQLTWARHGESGSMAVFHQTQGPSYSESKRLEFVAARPGAELRNASLRMFGLRVEDEGNYTCMFVMFPQGSRSVDIWLRVL

SEQ ID NO: 665 - protein, 122 aa, Artificial Sequence
  CD155 v119 IgV
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVL

SEQ ID NO: 666 - protein, 125 aa, Homo sapiens [sequence omitted]

SEQ ID NO: 667 - protein, 329 aa, Artificial Sequence
  CD112 v1 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 668 - protein, 329 aa, Artificial Sequence
  CD112 v2 ECD
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 669 - protein, 329 aa, Artificial Sequence
  CD112 v3 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 670 - protein, 329 aa, Artificial Sequence
  CD112 v4 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 671 - protein, 329 aa, Artificial Sequence
  CD112 v5 ECD
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 672 - protein, 329 aa, Artificial Sequence
  CD112 v6 ECD
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 673 - protein, 329 aa, Artificial Sequence
  CD112 v7 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 674 - protein, 329 aa, Artificial Sequence
  CD112 v8 ECD
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 675 - protein, 329 aa, Artificial Sequence
  CD112 v9 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 676 - protein, 329 aa, Artificial Sequence
  CD112 v10 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 677 - protein, 329 aa, Artificial Sequence
  CD112 v11 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 678 - protein, 329 aa, Artificial Sequence
  CD112 v12 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 679 - protein, 329 aa, Artificial Sequence
  CD112 v13 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 680 - protein, 329 aa, Artificial Sequence
  CD112 v14 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 681 - protein, 329 aa, Artificial Sequence
  CD112 v15 ECD
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 682 - protein, 329 aa, Artificial Sequence
  CD112 v16 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 683 - protein, 329 aa, Artificial Sequence
  CD112 v17 ECD
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 684 - protein, 329 aa, Artificial Sequence
  CD112 v18 ECD
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 685 - protein, 329 aa, Artificial Sequence
  CD112 v19 ECD
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 686 - protein, 329 aa, Artificial Sequence
  CD112 v20 ECD
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 687 - protein, 329 aa, Artificial Sequence
  CD112 v21 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 688 - protein, 329 aa, Artificial Sequence
  CD112 v22 ECD
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 689 - protein, 329 aa, Artificial Sequence
  CD112 v23 ECD
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 690 - protein, 329 aa, Artificial Sequence
  CD112 v24 ECD
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 691 - protein, 329 aa, Artificial Sequence
  CD112 v25 ECD
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 692 - protein, 329 aa, Artificial Sequence
  CD112 v26 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 693 - protein, 329 aa, Artificial Sequence
  CD112 v27 ECD
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 694 - protein, 329 aa, Artificial Sequence
  CD112 v28 ECD
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 695 - protein, 329 aa, Artificial Sequence
  CD112 v29 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 696 - protein, 329 aa, Artificial Sequence
  CD112 v30 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 697 - protein, 329 aa, Artificial Sequence
  CD112 v31 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 698 - protein, 329 aa, Artificial Sequence
  CD112 v32 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 699 - protein, 329 aa, Artificial Sequence
  CD112 v33 ECD
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 700 - protein, 329 aa, Artificial Sequence
  CD112 v34 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 701 - protein, 329 aa, Artificial Sequence
  CD112 v35 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 702 - protein, 329 aa, Artificial Sequence
  CD112 v36 ECD
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 703 - protein, 329 aa, Artificial Sequence
  CD112 v37 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 704 - protein, 329 aa, Artificial Sequence
  CD112 v38 ECD
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 705 - protein, 329 aa, Artificial Sequence
  CD112 v39 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 706 - protein, 329 aa, Artificial Sequence
  CD112 v40 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 707 - protein, 329 aa, Artificial Sequence
  CD112 v41 ECD
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 708 - protein, 329 aa, Artificial Sequence
  CD112 v42 ECD
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 709 - protein, 329 aa, Artificial Sequence
  CD112 v43 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 710 - protein, 329 aa, Artificial Sequence
  CD112 v44 ECD
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 711 - protein, 329 aa, Artificial Sequence
  CD112 v45 ECD
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 712 - protein, 329 aa, Artificial Sequence
  CD112 v46 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 713 - protein, 329 aa, Artificial Sequence
  CD112 v47 ECD
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 714 - protein, 125 aa, Artificial Sequence
  CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWL

SEQ ID NO: 715 - protein, 125 aa, Artificial Sequence
  CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWL

SEQ ID NO: 716 - protein, 125 aa, Artificial Sequence
  CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 717 - protein, 125 aa, Artificial Sequence
  CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWL

SEQ ID NO: 718 - protein, 125 aa, Artificial Sequence
  CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 719 - protein, 125 aa, Artificial Sequence
  CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWL

SEQ ID NO: 720 - protein, 125 aa, Artificial Sequence
  CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 721 - protein, 125 aa, Artificial Sequence
  CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWL

SEQ ID NO: 722 - protein, 125 aa, Artificial Sequence
  CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 723 - protein, 125 aa, Artificial Sequence
  CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWL

SEQ ID NO: 724 - protein, 125 aa, Artificial Sequence
  CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWL

SEQ ID NO: 725 - protein, 125 aa, Artificial Sequence
  CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 726 - protein, 125 aa, Artificial Sequence
  CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 727 - protein, 125 aa, Artificial Sequence
  CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWL

SEQ ID NO: 728 - protein, 125 aa, Artificial Sequence
  CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWL

SEQ ID NO: 729 - protein, 125 aa, Artificial Sequence
  CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 730 - protein, 125 aa, Artificial Sequence
  CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 731 - protein, 125 aa, Artificial Sequence
  CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWL

SEQ ID NO: 732 - protein, 125 aa, Artificial Sequence
  CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWL

SEQ ID NO: 733 - protein, 125 aa, Artificial Sequence
  CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWL

SEQ ID NO: 734 - protein, 125 aa, Artificial Sequence
  CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWL

SEQ ID NO: 735 - protein, 125 aa, Artificial Sequence
  CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 736 - protein, 125 aa, Artificial Sequence
  CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWL

SEQ ID NO: 737 - protein, 125 aa, Artificial Sequence
  CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWL

SEQ ID NO: 738 - protein, 125 aa, Artificial Sequence
  CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWL

SEQ ID NO: 739 - protein, 125 aa, Artificial Sequence
  CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWL

SEQ ID NO: 740 - protein, 125 aa, Artificial Sequence
  CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWL

SEQ ID NO: 741 - protein, 125 aa, Artificial Sequence
  CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWL

SEQ ID NO: 742 - protein, 125 aa, Artificial Sequence
  CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 743 - protein, 125 aa, Artificial Sequence
  CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWL

SEQ ID NO: 744 - protein, 125 aa, Artificial Sequence
  CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 745 - protein, 125 aa, Artificial Sequence
  CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 746 - protein, 125 aa, Artificial Sequence
  CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWL

SEQ ID NO: 747 - protein, 125 aa, Artificial Sequence
  CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 748 - protein, 125 aa, Artificial Sequence
  CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWL

SEQ ID NO: 749 - protein, 125 aa, Artificial Sequence
  CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWL

SEQ ID NO: 750 - protein, 125 aa, Artificial Sequence
  CD112 v37 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 751 - protein, 125 aa, Artificial Sequence
  CD112 v38 IgV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 752 - protein, 125 aa, Artificial Sequence
  CD112 v39 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 753 - protein, 125 aa, Artificial Sequence
  CD112 v40 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWL

SEQ ID NO: 754 - protein, 125 aa, Artificial Sequence
  CD112 v41 IgV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWL

SEQ ID NO: 755 - protein, 125 aa, Artificial Sequence
  CD112 v42 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 756 - protein, 125 aa, Artificial Sequence
  CD112 v43 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWL

SEQ ID NO: 757 - protein, 125 aa, Artificial Sequence
  CD112 v44 IgV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWL

SEQ ID NO: 758 - protein, 125 aa, Artificial Sequence
  CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWL

SEQ ID NO: 759 - protein, 125 aa, Artificial Sequence
  CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWL

SEQ ID NO: 760 - protein, 125 aa, Artificial Sequence
  CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWL

SEQ ID NO: 761 - protein, 127 aa, Homo sapiens
  MISC_FEATURE: CD112 IgV Wildtype
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRV

SEQ ID NO: 762 - protein, 127 aa, Artificial Sequence
  CD112 v1 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKDSVRGMTWLRV

SEQ ID NO: 763 - protein, 127 aa, Artificial Sequence
  CD112 v2 IgV
QDVRVQVLPEVRGQLGGTAELPCHLLPPVPGLHISLVTWQRPDAPANHQNVAAFHPKMGPSFPGPKPGSERLSFVSAKQGTGQDTEAELQDATLALHSLTVEDEGYYTCEFVTFPKGSVRGMTWLRV

SEQ ID NO: 764 - protein, 127 aa, Artificial Sequence
  CD112 v3 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 765 - protein, 127 aa, Artificial Sequence
  CD112 v4 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFITFPKGSVRGMTWLRV

SEQ ID NO: 766 - protein, 127 aa, Artificial Sequence
  CD112 v5 IgV
QDVRVQVLPEVRGQLGGTVELPCHLLPSVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 767 - protein, 127 aa, Artificial Sequence
  CD112 v6 IgV
QDVRVQVLPEVRGQLGGTVELPCHLLAPVPGLYISLVNWQRPDAPANHQNVAAFHPKMGPSFPSPKPGSERLSFVSAKQSTGQDTEAELQDATLALHGLTAEDEGNYTCEFVTFPKGSVRGMTWLRV

SEQ ID NO: 768 - protein, 127 aa, Artificial Sequence
  CD112 v7 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 769 - protein, 127 aa, Artificial Sequence
  CD112 v8 IgV
QDVRVQVLPEVWGQLGGTVELPCHLLPPVPGLYISLVTWQRPDAPANYQNVAASHPKMGPSFPSPKPGSERLSFVSAKQSTGQDTEAELQDATLALHGLTVEDEGNYTCEFATFPKGFVRGMTWLRV

SEQ ID NO: 770 - protein, 127 aa, Artificial Sequence
  CD112 v9 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 771 - protein, 127 aa, Artificial Sequence
  CD112 v10 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFASFPKGYVRGMTWLRV

SEQ ID NO: 772 - protein, 127 aa, Artificial Sequence
  CD112 v11 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGYVRGMTWLRV

SEQ ID NO: 773 - protein, 127 aa, Artificial Sequence
  CD112 v12 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 774 - protein, 127 aa, Artificial Sequence
  CD112 v13 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 775 - protein, 127 aa, Artificial Sequence
  CD112 v14 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLTPHGLTVEDEGNYTCEFATFPKGYVRGMTWLRV

SEQ ID NO: 776 - protein, 127 aa, Artificial Sequence
  CD112 v15 IgV
QDVRVQVLPEVRGQLGGTVELPCHLLPPVPGLHISLVTWQRPDAPANHQNVAAFHPKMGPSFPSPKSGSERLSFVSAKQSTGQDTEAELQDATLALHGLTVEDEGYYTCEFVTFPKGSVRGMTWLRV

SEQ ID NO: 777 - protein, 127 aa, Artificial Sequence
  CD112 v16 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 778 - protein, 127 aa, Artificial Sequence
  CD112 v17 IgV
QDVRVQVLPEVRGQLGGSVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 779 - protein, 127 aa, Artificial Sequence
  CD112 v18 IgV
QDVRVQVLSEVRGQLGGTVELPCHLLPPVPGLHISLVTWQRPDAPASHQNVAAFHPKMGPSFPSPKPGSERLSFVSAKQSTGQDTEAELQDATLALHGLTVEDEGNYTCEFVTFPKGSVRGMTWLRV

SEQ ID NO: 780 - protein, 127 aa, Artificial Sequence
  CD112 v19 IgV
QDVRVQVLPEVRGQLGGTVELPCHLLPPVPGLYISLVTWQRSDAPANHQNVAAFHPKMGPSFPSPKHGSERLSFVSAKQSTGQDTEAELQDATLALHGLTVEDEGNYTCEFVTFPKGSVRGMTWLRV

SEQ ID NO: 781 - protein, 127 aa, Artificial Sequence
  CD112 v20 IgV
QDVRVQVLPEVRGQLGGTVELPCHLLLPVPGPYISLVTWQRSDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 782 - protein, 127 aa, Artificial Sequence
  CD112 v21 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHDLTVEDEGNYTCEFVTFPKGSVRGMTWLRV

SEQ ID NO: 783 - protein, 127 aa, Artificial Sequence
  CD112 v22 IgV
QDVRVQVLPEVRGQLGGTVELPCHLLPPVPGLHIPLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 784 - protein, 127 aa, Artificial Sequence
  CD112 v23 IgV
QDVRVQVLPEVRGQLGGTVELPCHLLPPVPGPYISLVTWQRSDAPANHQNVAAFHPKMGPSFPSPKPGSERLSFVSAKQSTGQDTEAELQDATLALHGLAVEDEGNYTCEFVTFPKGSVRGMTWLRV

SEQ ID NO: 785 - protein, 127 aa, Artificial Sequence
  CD112 v24 IgV
QDVRVQVLPEVRGQLGGTVELPCHLLSPVPGLYISLVTWQRPDASANHQNVAAFHPKMGPSFPSPKPGSERLSFVSAKQSTGQDTEAELQDATLALHGLTVEDEGIYTCEFVTFPKGSVRGMTWLRV

SEQ ID NO: 786 - protein, 127 aa, Artificial Sequence
  CD112 v25 IgV
QDVRVQVLPEVRGQLGGTVELPCHLLPPVPGLHISLVTWQRPDAPAKHQNVAAFHPKMGPSFPSPKPGSERLSFVSAKQSTGQDTEAELQDATLALHGLTVEDEGNYTCEFVTFPKGSVRGMTWLRV

SEQ ID NO: 787 - protein, 127 aa, Artificial Sequence
  CD112 v26 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGSVRGMTWLRV

SEQ ID NO: 788 - protein, 127 aa, Artificial Sequence
  CD112 v27 IgV
QDVRVQVLPEVRGQLGGTVELPCHLLPPVPGLYISLVTWQRPDAPANHQNVAAFHPKMGPSFPSPKPGSERLSFVSARQSTGQGTEAELQDATLALHGLTVEDEGNYTCEFVTSPKGSVRGMTWLRV

SEQ ID NO: 789 - protein, 127 aa, Artificial Sequence
  CD112 v28 IgV
QDVRVQVLPEVRGQLGGTVELPCHLLPPVPGLHISLVTWQRPDAPAKHQNVAALHPKMGPSFPSPKPGSERLSFVSAKQSTGQDTEAELQDATLALHGLTVEDEGNYTCEFVTFPKGSVRGMTWLRV

SEQ ID NO: 790 - protein, 127 aa, Artificial Sequence
  CD112 v29 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 791 - protein, 127 aa, Artificial Sequence
  CD112 v30 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLVLHGLTVEDEGNYTCEFVTFPKGSVRGMTWLRV

SEQ ID NO: 792 - protein, 127 aa, Artificial Sequence
  CD112 v31 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 793 - protein, 127 aa, Artificial Sequence
  CD112 v32 IgV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 794 - protein, 127 aa, Artificial Sequence
  CD112 v33 IgV
QDVRVQVLPEVRGQLGGTVELPCHLLPPVPGLHISLVTWQRPDAPANHQNMAAFHPKMGPSFPSPKPGSERLSFVSAKQSTGQDTEAELQDATLALHGLTVEDEGNYTCEFVTFPKGSVRGMTWLRV

SEQ ID NO: 795 - protein, 127 aa, Artificial Sequence
  CD112 v34 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 796 - protein, 127 aa, Artificial Sequence
  CD112 v35 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTAEDEGNYTCEFVTFSKGSVRGMTWLRV

SEQ ID NO: 797 - protein, 127 aa, Artificial Sequence
  CD112 v36 IgV
QDVRVQVLPEVRGQLGGTVELPCRLLPPVPGLYISLVNWQRPGAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 798 - protein, 127 aa, Artificial Sequence
  CD112 v37 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 799 - protein, 127 aa, Artificial Sequence
  CD112 v38 gV
QDVRVQVLPEVRGQLGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 800 - protein, 127 aa, Artificial Sequence
  CD112 v39 gV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 801 - protein, 127 aa, Artificial Sequence
  CD112 v40 gV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRGITWLRV

SEQ ID NO: 802 - protein, 127 aa, Artificial Sequence
  CD112 v41 gV
QDVRVQVLPEVRGQLGGTVELPCHLLPPVPGLYISLVTWQRPDAPANHQNVAAFHPKMGPSFPSPKPGSERLSFVSAKQSTGKDTEAELQDATLALHGLTVEDEGYYTCEFVTFPKGSVRGMTWLRV

SEQ ID NO: 803 - protein, 127 aa, Artificial Sequence
  CD112 v42 gV
QDVRVQVLPEVWGQLGGTVELPCHLLSPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 804 - protein, 127 aa, Artificial Sequence
  CD112 v43 gV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGNYTCEFVTFPKGSVRGMTWLRV

SEQ ID NO: 805 - protein, 127 aa, Artificial Sequence
  CD112 v44 gV
QDVRVQVLPEVRGQLGGTVELPCHLLSPVPGLYISLVTWQRPDAPANHQNVAAFHPKMGPSFPSPKPGSERLSFVSAKQSTGQDTEAELRDATLALHGLTVEDEGNYTCEFVTFPKGSVRGMTWLRV

SEQ ID NO: 806 - protein, 127 aa, Artificial Sequence
  CD112 v45 IgV
QDVRVQVLPEVRGQVGGTVELPCHLLAPVPGLYISLVTWQRPDAPANHQNVAAFHPKMGPSFPSPKPGSERLSFVSAKQSTGQDTEAELQDATLALHGLTVEDEGNYTCEFVTFPKGTVRGMTWLRV

SEQ ID NO: 807 - protein, 127 aa, Artificial Sequence
  CD112 v46 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYICEFVTFPKGSVRGMTWLRV

SEQ ID NO: 808 - protein, 127 aa, Artificial Sequence
  CD112 v47 IgV
QDVRVQVLPEVRGQLGGTVELPCHLLPPVPGLHISLVTWQRPDAPANHQNVAAFHLKMGPSFPSPKPGSERLSFMSAKQSTGQDTEAELQDATLALHGLTMEDEGNYTCEFVTFPKGSVRGMTWLRV

SEQ ID NO: 809 - protein, 329 aa, Artificial Sequence
  CD112 v48 ECD
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 810 - protein, 329 aa, Artificial Sequence
  CD112 v49 ECD
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 811 - protein, 329 aa, Artificial Sequence
  CD112 v50 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 812 - protein, 329 aa, Artificial Sequence
  CD112 v51 ECD
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 813 - protein, 329 aa, Artificial Sequence
  CD112 v52 ECD
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 814 - protein, 329 aa, Artificial Sequence
  CD112 v53 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 815 - protein, 329 aa, Artificial Sequence
  CD112 v54 ECD
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 816 - protein, 329 aa, Artificial Sequence
  CD112 v55 ECD
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 817 - protein, 329 aa, Artificial Sequence; identical to SEQ ID NO: 816
  CD112 v56 ECD

SEQ ID NO: 818 - protein, 329 aa, Artificial Sequence
  CD112 v57 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 819 - protein, 329 aa, Artificial Sequence
  CD112 v58 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 820 - protein, 329 aa, Artificial Sequence
  CD112 v59 ECD
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 821 - protein, 329 aa, Artificial Sequence
  CD112 v60 ECD
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 822 - protein, 329 aa, Artificial Sequence
  CD112 v61 ECD
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 823 - protein, 329 aa, Artificial Sequence
  CD112 v62 ECD
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 824 - protein, 329 aa, Artificial Sequence
  CD112 v63 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 825 - protein, 329 aa, Artificial Sequence
  CD112 v64 ECD
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 826 - protein, 329 aa, Artificial Sequence
  CD112 v65 ECD
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 827 - protein, 329 aa, Artificial Sequence
  CD112 v66 ECD
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 828 - protein, 329 aa, Artificial Sequence
  CD112 v67 ECD
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 829 - protein, 329 aa, Artificial Sequence
  CD112 v68 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 830 - protein, 329 aa, Artificial Sequence
  CD112 v69 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 831 - protein, 329 aa, Artificial Sequence
  CD112 v70 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 832 - protein, 329 aa, Artificial Sequence
  CD112 v71 ECD
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 833 - protein, 329 aa, Artificial Sequence
  CD112 v72 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 834 - protein, 329 aa, Artificial Sequence
  CD112 v73 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 835 - protein, 329 aa, Artificial Sequence
  CD112 v74 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 836 - protein, 329 aa, Artificial Sequence
  CD112 v75 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 837 - protein, 329 aa, Artificial Sequence
  CD112 v76 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 838 - protein, 329 aa, Artificial Sequence
  CD112 v77 ECD
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 839 - protein, 329 aa, Artificial Sequence
  CD112 v78 ECD
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 840 - protein, 329 aa, Artificial Sequence
  CD112 v79 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 841 - protein, 329 aa, Artificial Sequence
  CD112 v80 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 842 - protein, 329 aa, Artificial Sequence
  CD112 v81 ECD
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 843 - protein, 329 aa, Artificial Sequence
  CD112 v82 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 844 - protein, 329 aa, Artificial Sequence
  CD112 v83 ECD
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 845 - protein, 329 aa, Artificial Sequence
  CD112 v84 ECD
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 846 - protein, 329 aa, Artificial Sequence
  CD112 v85 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 847 - protein, 329 aa, Artificial Sequence
  CD112 v86 ECD
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 848 - protein, 329 aa, Artificial Sequence
  CD112 v87 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 849 - protein, 329 aa, Artificial Sequence
  CD112 v88 ECD
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 850 - protein, 125 aa, Artificial Sequence
  CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWL

SEQ ID NO: 851 - protein, 125 aa, Artificial Sequence
  CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWL

SEQ ID NO: 852 - protein, 125 aa, Artificial Sequence
  CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWL

SEQ ID NO: 853 - protein, 125 aa, Artificial Sequence
  CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWL

SEQ ID NO: 854 - protein, 125 aa, Artificial Sequence
  CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWL

SEQ ID NO: 855 - protein, 125 aa, Artificial Sequence
  CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWL

SEQ ID NO: 856 - protein, 125 aa, Artificial Sequence
  CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 857 - protein, 125 aa, Artificial Sequence
  CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWL

SEQ ID NO: 858 - protein, 125 aa, Artificial Sequence
  CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWL

SEQ ID NO: 859 - protein, 125 aa, Artificial Sequence
  CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 860 - protein, 125 aa, Artificial Sequence
  CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWL

SEQ ID NO: 861 - protein, 125 aa, Artificial Sequence
  CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWL

SEQ ID NO: 862 - protein, 125 aa, Artificial Sequence
  CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWL

SEQ ID NO: 863 - protein, 125 aa, Artificial Sequence
  CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 864 - protein, 125 aa, Artificial Sequence
  CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWL

SEQ ID NO: 865 - protein, 125 aa, Artificial Sequence
  CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 866 - protein, 125 aa, Artificial Sequence
  CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 867 - protein, 125 aa, Artificial Sequence
  CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWL

SEQ ID NO: 868 - protein, 125 aa, Artificial Sequence
  CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWL

SEQ ID NO: 869 - protein, 125 aa, Artificial Sequence
  CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWL

SEQ ID NO: 870 - protein, 125 aa, Artificial Sequence
  CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 871 - protein, 125 aa, Artificial Sequence
  CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWL

SEQ ID NO: 872 - protein, 125 aa, Artificial Sequence
  CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 873 - protein, 125 aa, Artificial Sequence
  CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWL

SEQ ID NO: 874 - protein, 125 aa, Artificial Sequence
  CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWL

SEQ ID NO: 875 - protein, 125 aa, Artificial Sequence
  CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWL

SEQ ID NO: 876 - protein, 125 aa, Artificial Sequence
  CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 877 - protein, 125 aa, Artificial Sequence
  CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWL

SEQ ID NO: 878 - protein, 125 aa, Artificial Sequence
  CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWL

SEQ ID NO: 879 - protein, 125 aa, Artificial Sequence
  CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWL

SEQ ID NO: 880 - protein, 125 aa, Artificial Sequence
  CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWL

SEQ ID NO: 881 - protein, 125 aa, Artificial Sequence
  CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWL

SEQ ID NO: 882 - protein, 125 aa, Artificial Sequence
  CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWL

SEQ ID NO: 883 - protein, 125 aa, Artificial Sequence
  CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 884 - protein, 125 aa, Artificial Sequence
  CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWL

SEQ ID NO: 885 - protein, 125 aa, Artificial Sequence
  CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWL

SEQ ID NO: 886 - protein, 125 aa, Artificial Sequence
  CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWL

SEQ ID NO: 887 - protein, 125 aa, Artificial Sequence
  CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWL

SEQ ID NO: 888 - protein, 125 aa, Artificial Sequence
  CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWL

SEQ ID NO: 889 - protein, 125 aa, Artificial Sequence
  CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWL

SEQ ID NO: 890 - protein, 125 aa, Artificial Sequence
  CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWL

SEQ ID NO: 891 - protein, 127 aa, Artificial Sequence
  CD112 v48 IgV
QDVRVQVLPEVRGQLGGTVELPCHLLPPVPGLYISLVTWQRPDAPAKHQNVAAFHPKMGPSFPSPKPGSERLSFVSAKRSTGQDTEAELQDATLALHGLTVEDEGNYTCEFATFPKGFVRGMTWLRV

SEQ ID NO: 892 - protein, 127 aa, Artificial Sequence
  CD112 v49 IgV
QDVRVQVLPEVRGQLGGTVELPCHLLPPVPGLYISLVTWRRPDAPANHQNVAAFHPKMGTSFPSPKPGSERLSFVSAKQSTGQDTEAELQDATLALHGLTVEDEGNYTCEFVTFPKGTVRGMTWLRV

SEQ ID NO: 893 - protein, 127 aa, Artificial Sequence
  CD112 v50 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATYPKGFVRGMTWLRV

SEQ ID NO: 894 - protein, 127 aa, Artificial Sequence
  CD112 v51 IgV
QDVRVQVLPEVRGQLGGTVELPCHLLPPVPGLHISLVTWQRPDAPANHQNVAAFHPKMGPSFPSPKPGSERLSFVSARQSTGQDTEAELQDATLALHGLTVEDEGNYTCEFATFPKGYVRGMTWLRV

SEQ ID NO: 895 - protein, 127 aa, Artificial Sequence
  CD112 v52 IgV
QDVRVQVLPEVWGQLGGTVELPCHLLPPVPGLYISLVTWQRPDAPTNHQNVAAFHPKMGPSFPSPMPGSERLSFVSAKRSTGQDTEAELQDATLALHGLTVEDEGIYTCEFAAFPKGFVRGMTWLRV

SEQ ID NO: 896 - protein, 127 aa, Artificial Sequence
  CD112 v53 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGFVRGMTWLRV

SEQ ID NO: 897 - protein, 127 aa, Artificial Sequence
  CD112 v54 IgV
QDVRVQVLPEVWGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 898 - protein, 127 aa, Artificial Sequence
  CD112 v55 IgV
QDVRVQVLPEVRGQVGGTVELPCHLLPPVPGLYISLVTWQRPDAPANHQNVAAFHPKMGPSFPSPKPGSERLSFVSAKQSTGQDTEAELRDATLALHGLTVEDEGNYTCEFATFPKGFVRGMTWLRV

SEQ ID NO: 899 - protein, 127 aa, Artificial Sequence
  CD112 v56 IgV
QDVRVQVLPEVRGQLGGTVELPCHLLPPVPGLYISLVTWQRPDAPAKHQNVAAFHPKMGPSFPSPKPGSERLSFVSAKQSTGQGTEAELQDATLALHGLTVEDEGIYTCEFATFPKGYVRGMTWLRV

SEQ ID NO: 900 - protein, 127 aa, Artificial Sequence
  CD112 v57 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 901 - protein, 127 aa, Artificial Sequence
  CD112 v58 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFVTFPKGYVRGMTWLRV

SEQ ID NO: 902 - protein, 127 aa, Artificial Sequence
  CD112 v59 IgV
QDVRVQVLPEVRGQLGGAVELPCHLLPPVPGLYISLVTWQRPDAPANHQNVAAFHPKMGPSFPSPKPGSERLSFVSAKQSTGQDTEAELQDATLALHGLTVEDEGIYTCEFATFPKGTVRGMTWLRV

SEQ ID NO: 903 - protein, 127 aa, Artificial Sequence
  CD112 v60 IgV
QDVRVQVLPEVRGQVGGTVELPCHLLPPVPGLHISLVTWQRPDAPANHQNVAAFHPKMGPSFPSPKPGSERLSFVSAKQSTGQDTEAELQDATLALHGLTVEDEGYYTCEFVTFPKGFVRGMTWLRV

SEQ ID NO: 904 - protein, 127 aa, Artificial Sequence
  CD112 v61 IgV
QDVRVQVLPEVRGQLGGTVELPCHLLPPVPGLYISLMTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 905 - protein, 127 aa, Artificial Sequence
  CD112 v62 IgV
QDVRVQVLPEVRGQLGGTVELPCHLLPPVPGLYISLVTWQRPDAPAKHQNVAAFHPKMGPSFPSPKPGSERLSFVSAKQSTGQDTEAELQDATLALHGLTVEDEGNYTCEFVTFPKGYVRGMTWLRV

SEQ ID NO: 906 - protein, 127 aa, Artificial Sequence
  CD112 v63 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 907 - protein, 127 aa, Artificial Sequence
  CD112 v64 IgV
QDVRVQVLPEVRGQLGGTVELPCHLLPSVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 908 - protein, 127 aa, Artificial Sequence
  CD112 v65 IgV
QDVRVQVLPEVRGQLGGTVELPCHLLPPVSGLHISLVTWQRPDAPAKHQNVAAFHPKMGPSFPSPKPGSERLSFMSAKRSTGQDTEAELQDATLALHGLTVEDEGIYTCEFATFPKGYVRGMTWLRV

SEQ ID NO: 909 - protein, 127 aa, Artificial Sequence
  CD112 v66 IgV
QDVRVQVLPEVRGQLGGTAELPCHLLPPVPGLYISLVTWQRPDAPAKHQNVAAFHPKMGPSFPSPKPGSERLSFVSAKQSTGQDTEAELQDATLALHGLTVEDEGYYTCEFATFPEGYVRGMTWLRV

SEQ ID NO: 910 - protein, 127 aa, Artificial Sequence
  CD112 v67 IgV
QDVRVQVLPEVRGQLGGTVELPCHLLPPVPGLYISLVTWQRPDAPANHQNVAAFHPKMGPSFPSPKPGSERLSFVSAKRSTGQDAEAELQDATLALHGLTVEDEGNYTCEFVTFPKGYVRGMTWLRV

SEQ ID NO: 911 - protein, 127 aa, Artificial Sequence
  CD112 v68 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 912 - protein, 127 aa, Artificial Sequence
  CD112 v69 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFVTFPKGTVRGMTWLRV

SEQ ID NO: 913 - protein, 127 aa, Artificial Sequence
  CD112 v70 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 914 - protein, 127 aa, Artificial Sequence
  CD112 v71 IgV
QDVRVQVLPEVRGQLGGTVELPCHLLPPVPGLHISLVTWQRPDAPTNHQNVAAFHPKMGPSFPSPKPGSERLSFVSAKRSTGQDTEAELQDATLALHGLTVEDEGIYTCEFATFPKGFVRGMTWLRV

SEQ ID NO: 915 - protein, 127 aa, Artificial Sequence
  CD112 v72 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFVTFPKGSVRSMTWLRV

SEQ ID NO: 916 - protein, 127 aa, Artificial Sequence
  CD112 v73 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGIYTCEFATFPKGYVRGMTWLRV

SEQ ID NO: 917 - protein, 127 aa, Artificial Sequence
  CD112 v74 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 918 - protein, 127 aa, Artificial Sequence
  CD112 v75 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTMEDEGNYTCEFVTFPKGTVRGMTWLRV

SEQ ID NO: 919 - protein, 127 aa, Artificial Sequence
  CD112 v76 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGMTVEDEGIYTCEFATFPKGFVRGMTWLRV

SEQ ID NO: 920 - protein, 127 aa, Artificial Sequence
  CD112 v77 IgV
QDVRVQVLPEVRGQLGGTVELPCHLLPPVPGPYISLVTWQRPDAPANHQNVAAFHPKMGPSFPSPKPGSERLSFVSAKQSTGQDTEAELQDATLALHGLTVEDEGNYACEFATFPKGFVRGMTWLRV

SEQ ID NO: 921 - protein, 127 aa, Artificial Sequence
  CD112 v78 IgV
QDVRVQVLPEVWGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFVTFPKGSVRGMTWLRV

SEQ ID NO: 922 - protein, 127 aa, Artificial Sequence
  CD112 v79 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGYYTCGFVTFPKGSVRGMTWLRV

SEQ ID NO: 923 - protein, 127 aa, Artificial Sequence
  CD112 v80 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFATFPKGYVRGMTWLRV

SEQ ID NO: 924 - protein, 127 aa, Artificial Sequence
  CD112 v81 IgV
QDVRVQVLPEVRGQLGGTVELPCHLLPPVPGLYISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 925 - protein, 127 aa, Artificial Sequence
  CD112 v82 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHDLTMEDEGNYTCEFVTFPKGSVRGMTWLRV

SEQ ID NO: 926 - protein, 127 aa, Artificial Sequence
  CD112 v83 IgV
QDVRVQVLPEVRGQLGGTVELPCHLLPPVPGLYISLVTWQRPDAPAKHQNVAAFHPKMGPSFPSPKPGSERLSFVSAKQSSGQDTEAELQDATLALHGLTMEDEGNYTCEFVTFPKGFVRGMTWLRV

SEQ ID NO: 927 - protein, 127 aa, Artificial Sequence
  CD112 v84 IgV
QDVRVQVLPEVRGQLGGTVELPCHLLPPVPGLYISLVTWQRPDAPANHQNVAAFHPKMGPSFPSPKPGSERLSFVSAKQSTSQDTEAELQDATLALHGLTVEDEGNYTCEFATFPKGYVRGMTWLRV

SEQ ID NO: 928 - protein, 127 aa, Artificial Sequence
  CD112 v85 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGYVRGMTWLRV

SEQ ID NO: 929 - protein, 127 aa, Artificial Sequence
  CD112 v86 IgV
QDVRVQVLPEVRGQLGGTVELPCHLLPPVPGLHISLVTWQRPDAPAKHQNVAAFHPKMGPSFPSPKPGSERLSFVSAKRSTGQDTEAELQDATLALHGLTVEDEGYYTCEFVTFPKGSVRGMTWLRV

SEQ ID NO: 930 - protein, 127 aa, Artificial Sequence
  CD112 v87 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFATFPKGTVRGMTWLRV

SEQ ID NO: 931 - protein, 127 aa, Artificial Sequence
  CD112 v88 IgV
QDVRVQVLPEVWGQLGGTVELPCHLLPPVPGLHISLVTWQRPDAPANHQNVAAFHPKMGPSFPSPKPGSERLSFVSAKRSTGQDTEAELQDATLALHGLTMEDEGNYTCEFVTFPKGSVRGMTWLRV

SEQ ID NO: 932 - protein, 208 aa, Artificial Sequence
  CD80 v122 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 933 - protein, 208 aa, Artificial Sequence
  CD80 v123 ECD
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 934 - protein, 208 aa, Artificial Sequence
  CD80 v124 ECD
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 935 - protein, 208 aa, Artificial Sequence
  CD80 v125 ECD
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 936 - protein, 208 aa, Artificial Sequence
  CD80 v126 ECD
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 937 - protein, 208 aa, Artificial Sequence
  CD80 v127 ECD
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 938 - protein, 208 aa, Artificial Sequence
  CD80 v128 ECD
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 939 - protein, 208 aa, Artificial Sequence
  CD80 v130 ECD
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 940 - protein, 208 aa, Artificial Sequence
  CD80 v131 ECD
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 941 - protein, 208 aa, Artificial Sequence
  CD80 v132 ECD
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 942 - protein, 208 aa, Artificial Sequence
  CD80 v133 ECD
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 943 - protein, 208 aa, Artificial Sequence
  CD80 v134 ECD
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 944 - protein, 208 aa, Artificial Sequence
  CD80 v135 ECD
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 945 - protein, 208 aa, Artificial Sequence
  CD80 v136 ECD
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 946 - protein, 208 aa, Artificial Sequence
  CD80 v137 ECD
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 947 - protein, 208 aa, Artificial Sequence
  CD80 v138 ECD
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 948 - protein, 208 aa, Artificial Sequence
  CD80 v139 ECD
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 949 - protein, 208 aa, Artificial Sequence
  CD80 v140 ECD
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 950 - protein, 208 aa, Artificial Sequence
  CD80 v141 ECD
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 951 - protein, 208 aa, Artificial Sequence
  CD80 v142 ECD
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 952 - protein, 208 aa, Artificial Sequence
  CD80 v143 ECD
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 953 - protein, 208 aa, Artificial Sequence
  CD80 v144 ECD
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 954 - protein, 208 aa, Artificial Sequence
  CD80 v145 ECD
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 955 - protein, 208 aa, Artificial Sequence
  CD80 v146 ECD
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 956 - protein, 208 aa, Artificial Sequence
  CD80 v147 ECD
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 957 - protein, 208 aa, Artificial Sequence
  CD80 v148 ECD
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 958 - protein, 208 aa, Artificial Sequence
  CD80 v149 ECD
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 959 - protein, 208 aa, Artificial Sequence
  CD80 v150 ECD
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 960 - protein, 208 aa, Artificial Sequence
  CD80 v151 ECD
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 961 - protein, 208 aa, Artificial Sequence
  CD80 v152 ECD
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 962 - protein, 208 aa, Artificial Sequence
  CD80 v153 ECD
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 963 - protein, 208 aa, Artificial Sequence
  CD80 v154 ECD
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 964 - protein, 208 aa, Artificial Sequence
  CD80 v155 ECD
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 965 - protein, 208 aa, Artificial Sequence
  CD80 v156 ECD
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 966 - protein, 208 aa, Artificial Sequence
  CD80 v157 ECD
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 967 - protein, 208 aa, Artificial Sequence
  CD80 v158 ECD
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 968 - protein, 208 aa, Artificial Sequence
  CD80 v159 ECD
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 969 - protein, 208 aa, Artificial Sequence
  CD80 v160 ECD
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 970 - protein, 208 aa, Artificial Sequence
  CD80 v161 ECD
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 971 - protein, 208 aa, Artificial Sequence
  CD80 v162 ECD
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 972 - protein, 208 aa, Artificial Sequence
  CD80 v163 ECD
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 973 - protein, 208 aa, Artificial Sequence
  CD80 v164 ECD
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 974 - protein, 208 aa, Artificial Sequence
  CD80 v165 ECD
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 975 - protein, 208 aa, Artificial Sequence; identical to SEQ ID NO: 957
  CD80 v166 ECD

SEQ ID NO: 976 - protein, 208 aa, Artificial Sequence
  CD80 v167 ECD
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 977 - protein, 208 aa, Artificial Sequence
  CD80 v168 ECD
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 978 - protein, 208 aa, Artificial Sequence
  CD80 v169 ECD
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 979 - protein, 208 aa, Artificial Sequence
  CD80 v170 ECD
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 980 - protein, 208 aa, Artificial Sequence
  CD80 v171 ECD
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 981 - protein, 208 aa, Artificial Sequence
  CD80 v172 ECD
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 982 - protein, 208 aa, Artificial Sequence
  CD80 v173 ECD
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 983 - protein, 208 aa, Artificial Sequence
  CD80 v174 ECD
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 984 - protein, 208 aa, Artificial Sequence
  CD80 v175 ECD
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 985 - protein, 208 aa, Artificial Sequence
  CD80 v176 ECD
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 986 - protein, 208 aa, Artificial Sequence
  CD80 v177 ECD
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 987 - protein, 208 aa, Artificial Sequence
  CD80 v178 ECD
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 988 - protein, 208 aa, Artificial Sequence
  CD80 v179 ECD
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 989 - protein, 208 aa, Artificial Sequence
  CD80 v180 ECD
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 990 - protein, 208 aa, Artificial Sequence
  CD80 v181 ECD
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 991 - protein, 208 aa, Artificial Sequence
  CD80 v182 ECD
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 992 - protein, 208 aa, Artificial Sequence
  CD80 v183 ECD
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 993 - protein, 208 aa, Artificial Sequence
  CD80 v184 ECD
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 994 - protein, 208 aa, Artificial Sequence
  CD80 v185 ECD
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 995 - protein, 208 aa, Artificial Sequence
  CD80 v186 ECD
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 996 - protein, 208 aa, Artificial Sequence
  CD80 v187 ECD
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 997 - protein, 208 aa, Artificial Sequence
  CD80 v188 ECD
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 998 - protein, 208 aa, Artificial Sequence
  CD80 v189 ECD
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 999 - protein, 208 aa, Artificial Sequence
  CD80 v190 ECD
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 1000 - protein, 208 aa, Artificial Sequence
  CD80 v191 ECD
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 1001 - protein, 208 aa, Artificial Sequence
  CD80 v192 ECD
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 1002 - protein, 208 aa, Artificial Sequence
  CD80 v193 ECD
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 1003 - protein, 208 aa, Artificial Sequence
  CD80 v194 ECD
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 1004 - protein, 208 aa, Artificial Sequence
  CD80 v195 ECD
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 1005 - protein, 101 aa, Artificial Sequence
  CD80 WT IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVT

SEQ ID NO: 1006 - protein, 101 aa, Artificial Sequence
  CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVT

SEQ ID NO: 1007 - protein, 101 aa, Artificial Sequence
  CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVT

SEQ ID NO: 1008 - protein, 101 aa, Artificial Sequence
  CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVT

SEQ ID NO: 1009 - protein, 101 aa, Artificial Sequence
  CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVT

SEQ ID NO: 1010 - protein, 101 aa, Artificial Sequence
  CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 1011 - protein, 101 aa, Artificial Sequence
  CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVT

SEQ ID NO: 1012 - protein, 101 aa, Artificial Sequence
  CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVT

SEQ ID NO: 1013 - protein, 101 aa, Artificial Sequence
  CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVT

SEQ ID NO: 1014 - protein, 101 aa, Artificial Sequence
  CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVT

SEQ ID NO: 1015 - protein, 101 aa, Artificial Sequence
  CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVT

SEQ ID NO: 1016 - protein, 101 aa, Artificial Sequence
  CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVT

SEQ ID NO: 1017 - protein, 101 aa, Artificial Sequence
  CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVT

SEQ ID NO: 1018 - protein, 101 aa, Artificial Sequence
  CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVT

SEQ ID NO: 1019 - protein, 101 aa, Artificial Sequence
  CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVT

SEQ ID NO: 1020 - protein, 101 aa, Artificial Sequence
  CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVT

SEQ ID NO: 1021 - protein, 101 aa, Artificial Sequence
  CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVT

SEQ ID NO: 1022 - protein, 101 aa, Artificial Sequence
  CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVT

SEQ ID NO: 1023 - protein, 101 aa, Artificial Sequence
  CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVT

SEQ ID NO: 1024 - protein, 101 aa, Artificial Sequence
  CD80 v141 IgV
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVT

SEQ ID NO: 1025 - protein, 101 aa, Artificial Sequence
  CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVT

SEQ ID NO: 1026 - protein, 101 aa, Artificial Sequence
  CD80 v143 IgV
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVT

SEQ ID NO: 1027 - protein, 101 aa, Artificial Sequence
  CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVT

SEQ ID NO: 1028 - protein, 101 aa, Artificial Sequence
  CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVT

SEQ ID NO: 1029 - protein, 101 aa, Artificial Sequence
  CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVT

SEQ ID NO: 1030 - protein, 101 aa, Artificial Sequence
  CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVT

SEQ ID NO: 1031 - protein, 101 aa, Artificial Sequence
  CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVT

SEQ ID NO: 1032 - protein, 101 aa, Artificial Sequence
  CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVT

SEQ ID NO: 1033 - protein, 101 aa, Artificial Sequence
  CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVT

SEQ ID NO: 1034 - protein, 101 aa, Artificial Sequence
  CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVT

SEQ ID NO: 1035 - protein, 101 aa, Artificial Sequence
  CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVT

SEQ ID NO: 1036 - protein, 101 aa, Artificial Sequence
  CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVT

SEQ ID NO: 1037 - protein, 101 aa, Artificial Sequence
  CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVT

SEQ ID NO: 1038 - protein, 101 aa, Artificial Sequence
  CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVT

SEQ ID NO: 1039 - protein, 101 aa, Artificial Sequence
  CD80 v156 IgV
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVT

SEQ ID NO: 1040 - protein, 101 aa, Artificial Sequence
  CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVT

SEQ ID NO: 1041 - protein, 101 aa, Artificial Sequence
  CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVT

SEQ ID NO: 1042 - protein, 101 aa, Artificial Sequence
  CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVT

SEQ ID NO: 1043 - protein, 101 aa, Artificial Sequence
  CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVT

SEQ ID NO: 1044 - protein, 101 aa, Artificial Sequence
  CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVT

SEQ ID NO: 1045 - protein, 101 aa, Artificial Sequence
  CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVT

SEQ ID NO: 1046 - protein, 101 aa, Artificial Sequence
  CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVT

SEQ ID NO: 1047 - protein, 101 aa, Artificial Sequence
  CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVT

SEQ ID NO: 1048 - protein, 101 aa, Artificial Sequence
  CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVT

SEQ ID NO: 1049 - protein, 101 aa, Artificial Sequence; identical to SEQ ID NO: 1031
  CD80 v166 IgV

SEQ ID NO: 1050 - protein, 101 aa, Artificial Sequence
  CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVT

SEQ ID NO: 1051 - protein, 101 aa, Artificial Sequence
  CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVT

SEQ ID NO: 1052 - protein, 101 aa, Artificial Sequence
  CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVT

SEQ ID NO: 1053 - protein, 101 aa, Artificial Sequence
  CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVT

SEQ ID NO: 1054 - protein, 101 aa, Artificial Sequence
  CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVT

SEQ ID NO: 1055 - protein, 101 aa, Artificial Sequence
  CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVT

SEQ ID NO: 1056 - protein, 101 aa, Artificial Sequence
  CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVT

SEQ ID NO: 1057 - protein, 101 aa, Artificial Sequence
  CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVT

SEQ ID NO: 1058 - protein, 101 aa, Artificial Sequence
  CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVT

SEQ ID NO: 1059 - protein, 101 aa, Artificial Sequence
  CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVT

SEQ ID NO: 1060 - protein, 101 aa, Artificial Sequence
  CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVT

SEQ ID NO: 1061 - protein, 101 aa, Artificial Sequence
  CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVT

SEQ ID NO: 1062 - protein, 101 aa, Artificial Sequence
  CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVT

SEQ ID NO: 1063 - protein, 101 aa, Artificial Sequence
  CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVT

SEQ ID NO: 1064 - protein, 101 aa, Artificial Sequence
  CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVT

SEQ ID NO: 1065 - protein, 101 aa, Artificial Sequence
  CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVT

SEQ ID NO: 1066 - protein, 101 aa, Artificial Sequence
  CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVT

SEQ ID NO: 1067 - protein, 101 aa, Artificial Sequence
  CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVT

SEQ ID NO: 1068 - protein, 101 aa, Artificial Sequence
  CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVT

SEQ ID NO: 1069 - protein, 101 aa, Artificial Sequence
  CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVT

SEQ ID NO: 1070 - protein, 101 aa, Artificial Sequence
  CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVT

SEQ ID NO: 1071 - protein, 101 aa, Artificial Sequence
  CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVT

SEQ ID NO: 1072 - protein, 101 aa, Artificial Sequence
  CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVT

SEQ ID NO: 1073 - protein, 101 aa, Artificial Sequence
  CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVT

SEQ ID NO: 1074 - protein, 101 aa, Artificial Sequence
  CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVT

SEQ ID NO: 1075 - protein, 101 aa, Artificial Sequence
  CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVT

SEQ ID NO: 1076 - protein, 101 aa, Artificial Sequence
  CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVT

SEQ ID NO: 1077 - protein, 101 aa, Artificial Sequence
  CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVT

SEQ ID NO: 1078 - protein, 101 aa, Artificial Sequence
  CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVT

SEQ ID NO: 1079 - protein, 107 aa, Artificial Sequence
  CD80 WT IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKAD

SEQ ID NO: 1080 - protein, 107 aa, Artificial Sequence
  CD80 v122 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDAFKREHLAEVTLSVKAD

SEQ ID NO: 1081 - protein, 107 aa, Artificial Sequence
  CD80 v123 IgV
VIHVTKEVKEVATLSCGHNVSVEELAQTRFYWQKEKKMVLTMMSGDMNIWPEYKNRTIFDITNNLSIVIPALRPSDEGTYECVVLKYEKDAFKREHLAEVTLSVKAD

SEQ ID NO: 1082 - protein, 107 aa, Artificial Sequence
  CD80 v124 IgV
VIHVTKEVKEVATLSCGHNVSVEELAHTRIYWQKEKKMVLSMMSGDMNIWPEYKNRTIFDITNNLSIVILDLRPSDEGTYECVVLKYEKDAFKREHLAEVTLSVKAD

SEQ ID NO: 1083 - protein, 107 aa, Artificial Sequence
  CD80 v125 IgV
VIHVTKEVKEVATLSCGHNVSVEELAQTRTYWQKEKKMVLTMMSGDMNIWPEYKNRTIFDITNNLSIVIRALRPSDEGTYECVVLKYEKDAFKREHLAEVTLSVKAD

SEQ ID NO: 1084 - protein, 107 aa, Artificial Sequence
  CD80 v126 IgV
VIHVTKEVKEVARLSRGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 1085 - protein, 107 aa, Artificial Sequence
  CD80 v127 IgV
VIHVTKEVKEVATLSCGHNVSVEELAQTRIYWQKEKKMVLTMMSGDMNIWPEYKNRIIFDITNNLSIVILALRPSDEGTYECVVLKYEKDAFKREHLAEVTLSVKAD

SEQ ID NO: 1086 - protein, 107 aa, Artificial Sequence
  CD80 v128 IgV
VIHVTKEVKEVATLSCGHNVSVEELAQTRIYWQKEKKMVLTMISGDMNIWPEYKNRTIFDITNNLSIVILALRPSDEGTYERVVLKYEKDAFKREHLAEVTLSVKAD

SEQ ID NO: 1087 - protein, 107 aa, Artificial Sequence
  CD80 v130 IgV
VIHVTKEVKEVATLSCGHNVSLEELAQTRIYWQKEKKVVLTMMSGDTNIWPEYKNRTIFDITNNLSIVILDLRPSDEGTYECVVMKYEKDAFKREHLAEVTLSVKAD

SEQ ID NO: 1088 - protein, 107 aa, Artificial Sequence
  CD80 v131 IgV
VIHVTKEVKEVATLSCGHNVSVEELAQTRVYWQKEKKMVLTMMSGDMNIWPEYKNRIIFDITNNLSIVIPDLRPSDEGTYECVVLKYEKDTFKREHLAEVTLSVKAD

SEQ ID NO: 1089 - protein, 107 aa, Artificial Sequence
  CD80 v132 IgV
VIHVTKEVKEVATLSCGHNVSIEELAQTRIYWQKEKKMVLTMMSGDMNIWPEYKNRTIFDITNNLSIVIMDLRPSDEGTYECVVLKYEKDAFKREHLAEVTLSVKAD

SEQ ID NO: 1090 - protein, 107 aa, Artificial Sequence
  CD80 v133 IgV
VIHVTKEVKEVATLSCGHNVSVEELAQTRIYWQKEKKMVLTMMSGDMNIWPEYKDRTIFDITNNLSIVIPALRPSDGGTYECVVLKYEKDAFKREHLAEVTLSVKAD

SEQ ID NO: 1091 - protein, 107 aa, Artificial Sequence
  CD80 v134 IgV
VIHVTKEVKEVATLSCGHNVSVEELAQTRIYWQKEKKMVLTMMSGDMNIWPEYKNRAIFDITNNLSIVTLALRPSDEGTYECVVLKYEKDAFKREHLAEVTLSVKAD

SEQ ID NO: 1092 - protein, 107 aa, Artificial Sequence
  CD80 v135 IgV
VIHVTKEVKEVATLSCGHNVSVEELAQTRIYWQKEKKMVLTMMSGDMNIWPEYKDRTIFDITNNLSIVILALRPSDEGTYECVVLMYEKDAFKREHLAEVTLSVKAD

SEQ ID NO: 1093 - protein, 107 aa, Artificial Sequence
  CD80 v136 IgV
VIHVTKEVKEVATLSCGHNVSVEELAQTRIYWQKEKKMVLTMMSGDMNIWPEYKNRTIFDITNNLSIVILAPRPSDEGIYECVVLKYEKDAFKREHLAEVTLSVKAD

SEQ ID NO: 1094 - protein, 107 aa, Artificial Sequence
  CD80 v137 IgV
VIHVTKEVKEVATLSCGHNVSVEELAQTRIYWQKEKKMVLTMMSGDMNIWPEYKNRTIFDITNNLSIVIPALRPSDEGTYECVVLKYEKDASKREHLAEVTLSVKAD

SEQ ID NO: 1095 - protein, 107 aa, Artificial Sequence
  CD80 v138 IgV
VIHVTKEVKEVATLSCGHNVSVEELAQTRIYWQKEKKMVLTMMSGDMNIWPEYKNRTIFDITNNLSIVILALRPSDEGPYECVVLKYEKDAFKREHLAEVTLSVKAD

SEQ ID NO: 1096 - protein, 107 aa, Artificial Sequence
  CD80 v139 IgV
VIHVTKEVKEVATLSCGHNVSVEELAQTRIYWQKDKKMVLTMMSGDINIWPEYKNRTIFDITNNPSIVILALRPSDEGTYECVVLKYEKNAFKREHLAEVTLSVKAD

SEQ ID NO: 1097 - protein, 107 aa, Artificial Sequence
  CD80 v140 IgV
VIHVTKEVKEVATLSCGHNVSVEESAQTRIYWQKDKKMVLTMMSGDINIWPEYKNRTIFDITNNLSIVILALRPSDEGTYECVVLKYEKNAFKREHLAEVTLSVKAD

SEQ ID NO: 1098 - protein, 107 aa, Artificial Sequence
  CD80 v141 IgV
VIHVTKEVKEVATLSCGHNVSVEELAQTRIYWQKEKKMVLTMMPGDMNIWPEYKNRTIFDITNNLSTVILALRSSDEGTYGCVVLKYEKDAFKRDHLAEVTLSVKAD

SEQ ID NO: 1099 - protein, 107 aa, Artificial Sequence
  CD80 v142 IgV
VIHVTKEVKEVATLSCGHNVSVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 1100 - protein, 107 aa, Artificial Sequence
  CD80 v143 IgV
VIHVTKEVKEVAALSCGHNVSVEELAQTRIYWQKEKKMVLTMMSGDMNIWPEYKNRTIFDNTNNLSIVILDLRPSDEGTYECVVLKYEKDAFKREHLAEVTLSVKAD

SEQ ID NO: 1101 - protein, 107 aa, Artificial Sequence
  CD80 v144 IgV
VIHVTKEVKEVATLSCGHNVSVEELAQTRIYWQKEKKMVLTMMSGDMNIWPEYKNRTIFDITNNLSIVILALRPSDEGTYKCVVLKYEKDSFKREHLAEVTLSVKAD

SEQ ID NO: 1102 - protein, 107 aa, Artificial Sequence
  CD80 v145 IgV
VIHVTKEVKEVVTLSCGHNVSVEELAQTRIYWQKEKKMVLTMMSGDVNIWPEYKNRTIFDITNNLSIVIMALRPSDEGTYECVVLKYEKDAFKREHLAEVTLSVKAD

SEQ ID NO: 1103 - protein, 107 aa, Artificial Sequence
  CD80 v146 IgV
VIHVTKEVKEVATLSCGHNVSVEELAQTRIYWQEEKKMVLAMMSGDMNIWPEYKNRTIFDITNNLSIVILAVRPSDEGTYECVVLKYEKDAFKREHLAEVTLSVKAD

SEQ ID NO: 1104 - protein, 107 aa, Artificial Sequence
  CD80 v147 IgV
VIHVTKEVKEVATLSCGHNVSVEELAQTRIYWQKEKKMVLSMMSGDMNIWPEYKNRTIFDITNNLSIVILDLRPSDEGTYECVALKYEKDAFKREHLAEVTLSVKAD

SEQ ID NO: 1105 - protein, 107 aa, Artificial Sequence
  CD80 v148 IgV
VIHVTKEVKEVATLSCGHNVSVEELAQTRIYWQKDKKMVLTMMSGDMNIWPEYKNRTIFDITNNLSIVILDLRPSDEGTYECVVLKYEKDAFKREHLAEVTLSVKAD

SEQ ID NO: 1106 - protein, 107 aa, Artificial Sequence
  CD80 v149 IgV
VIHVTKEVKEVATLSCGHNVSVEELAQTRIYWQKDKKMVLTMMSGDINIWPEYKNRTIFDITNNLSIVILALRPSDEGTYECVVLKYEKDAFKREHLAEVTLSVKAD

SEQ ID NO: 1107 - protein, 107 aa, Artificial Sequence
  CD80 v150 IgV
VIHVTKEVKEVATLSCGHNVSVEELAQTRIYWQKERKMVLTMMSGDMNIWPEYKNRTIFDITNNLSIVILALRPSDEATYECVVLKYEKDAFKREHLAEVTLSVKAD

SEQ ID NO: 1108 - protein, 107 aa, Artificial Sequence
  CD80 v151 IgV
VIHVTKEVKEVATLSCGHNVSVEELAQTRIYWEKEKKMVLAMMSGDMNIWPEYKNRTIFDITNNLSIVILALRPSDEGTYECVVLKYEKDAFKREHLAEVTLSVKAD

SEQ ID NO: 1109 - protein, 107 aa, Artificial Sequence
  CD80 v152 IgV
VIHVTKEVKEVATLSCGHNVSVEELAQTRIYWQKEKKMVLTMMSGDVHIWPEYKNRTIFDITNNLSIVILALRPSDEGTYECVVLKYEKDAFKREHLAEVTLSVKAD

SEQ ID NO: 1110 - protein, 107 aa, Artificial Sequence
  CD80 v153 IgV
VIHVTKEVKEVATLSCGHNVSVEELAQTRIYWQKEKKMVLTMMSGDLNIWPEYKNRTIFDITNNLSIAILALRPSDEGTYECVVLKYEKDAFKREHLAEVTLSVKAD

SEQ ID NO: 1111 - protein, 107 aa, Artificial Sequence
  CD80 v154 IgV
VIHVTKEVKEVATLSCGHNVSVEELAQTRIYWQKEKKMVLTMMPGDMNIWPEYKNRTIFDITNNLSIVILDLRPSDEGTYECVVLKYEKDAFKREHLAEVTLSVKAD

SEQ ID NO: 1112 - protein, 107 aa, Artificial Sequence
  CD80 v155 IgV
VIHVTKEVKEVATLSCGHNVSVEELAHTRIYWQKEKKMVLTMISGDMNIWPEYKNRTIFDITNNLSIVILDLSPSDEGTYECVVLKYEKDAFKREHLAEVTLSVKAD

SEQ ID NO: 1113 - protein, 107 aa, Artificial Sequence
  CD80 v156 IgV
  VARIANT (24)..(24): X is unknown
VIHVTKEVKEVATLSCGHNVSVEXLAQTRIYWRKEKKMVLTMMSGDMNIWPEYNNRIIFDITNNLSVVILDLRPSDEGTYECVVLKYEKDAFKREHLAEVTLSVKAD

SEQ ID NO: 1114 - protein, 107 aa, Artificial Sequence
  CD80 v157 IgV
VIHVTKEVKEVATLSCGHNVSVEELAQTRIYWQKDKKMVLTMMSGDMNIWPEYKNRIIFDITNNLSIVIQDLRPSDEGTYECVVLKYEKDAFKREHLAEVTLSVKAD

SEQ ID NO: 1115 - protein, 107 aa, Artificial Sequence
  CD80 v158 IgV
VIHVTKEVKEVATLSCGHNVSVEELAQTRIYWQKEKKMVLTMMSGDINIWPEYKNRTIFDITNNLSIVILALRPSDEGTYECVVLKYDKDAFKREHLAEVTLSVKAD

SEQ ID NO: 1116 - protein, 107 aa, Artificial Sequence
  CD80 v159 IgV
VIHVTKEVKEVATLSCGHNVSVEELAQTRIYWQKEKKMVLTIMSGDMNIWPEYKNRTIFDVTNNLSIVILDLRPSDEGTYECVVLKYEKDAFKREHLAEVTLSVKAD

SEQ ID NO: 1117 - protein, 107 aa, Artificial Sequence
  CD80 v160 IgV
VIHVTKEVKEVATLSCGHNVSVEELAQTRIYWQKEKKMVLTMMSGDMNIWAEYKNRTIFDITNNLSIVILDLRPSDEGTYECVVLKYEKDAFKREHLAEVTLSVKAD

SEQ ID NO: 1118 - protein, 107 aa, Artificial Sequence
  CD80 v161 IgV
VIHVTKEVKEVATLSCGYNVSVEELAQTRIYWQKEKKMVLTMMSGDINIWPEYKNRIIFDITNNLSIVILGLRPSDEGTYECVVLKYEKDAFKREHLAEVTLSVKAD

SEQ ID NO: 1119 - protein, 107 aa, Artificial Sequence
  CD80 v162 IgV
VIHVTKEVKEVATLSCGHNISVEELAQTRIYWQKEKKMVLTMMSGDVNIWPEYKNRIIFDITNNLSIVILALRPSDEGTYECVILKYEKDAFKREHLAEVTLSVKAD

SEQ ID NO: 1120 - protein, 107 aa, Artificial Sequence
  CD80 v163 IgV
VIHVTKEVKEVATLSCGHNISVEELAQTRIYWQKEKKMVLTMMSGDVNIWPEYKNRTIFDITNNLSIVILDLRPSDEGTYECVVLKYEKDAFKREHLAEVTLSVKAD

SEQ ID NO: 1121 - protein, 107 aa, Artificial Sequence
  CD80 v164 IgV
VIHVTKEVKEVATLSCGHNVSVEELAQTRIYWQKEKKMVLTMMSGDMNIWPEYKNRTIFDITNNLSIVILDVRPSDEGTYECVVLKYEKDAFKRKHLAEVTLSVKAD

SEQ ID NO: 1122 - protein, 107 aa, Artificial Sequence
  CD80 v165 IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVTLSVKAD

SEQ ID NO: 1123 - protein, 107 aa, Artificial Sequence; identical to SEQ ID NO: 1105
  CD80 v166 IgV

SEQ ID NO: 1124 - protein, 107 aa, Artificial Sequence
  CD80 v167 IgV
VIHVTKEVKEVATLSCGHNVSVEELAQTRIYWQKDKKMVLTMMSGDMNIWPEYKNRTIFDITNNLSLVILDLRPSDEGTYECVVLKYEKDAFKREHLAEVTLSVKAD

SEQ ID NO: 1125 - protein, 107 aa, Artificial Sequence
  CD80 v168 IgV
VIHVTKEVKEVATLSCGHNVSVEELAHTRIYWQKGKKMVLTMMSGDMNIWPEYKNRTIFDITNNLSIVILDPRPSDEGIYECVVLKYEKDAFKREHLAEVTLSVKAD

SEQ ID NO: 1126 - protein, 107 aa, Artificial Sequence
  CD80 v169 IgV
VIHVTKEVKEVARLSCGHNVSVEELAQTRIYWQKEKKMVLTVMSGDINIWPEYKNRTIFDITNNLSIVILDLRPSDEGTYECVVLKYEKDAFKREHLAEVTLSVKAD

SEQ ID NO: 1127 - protein, 107 aa, Artificial Sequence
  CD80 v170 IgV
VIHVTKEVKEVATLSCGHNVSVEELAQTRIYWQKDKKMVLTMMSGDMNIWPEYKNRTIFDITNNLSIVILALRPSDEGTYECVVLKYEKDAFKREHLAEVTLSVKAD

SEQ ID NO: 1128 - protein, 107 aa, Artificial Sequence
  CD80 v171 IgV
VIHVTKEVKEVATLSCGHNVSVEELAQTRIYWQKDKKMVLTMMSGDINIWPEYKNRTIFDITNNLSIVIMALRPSDEGTYECVVLKYEKDAFKREHLAEVTLSVKAD

SEQ ID NO: 1129 - protein, 107 aa, Artificial Sequence
  CD80 v172 IgV
VIHVTKEVKEVATLSCGHNVSVEELAQTRIYWQKDKKMVLTMMSGDMNIWPEYKNRTIFDITNNLSIVILDVRPSDEGTYECVVLKYEKDAFKREHLAEVTLSVKAD

SEQ ID NO: 1130 - protein, 107 aa, Artificial Sequence
  CD80 v173 IgV
VIHVTKEVKEVATLSCGHNVSVEELAQTRIYWQKDKKMVLTMLSGDMNIWPEYKNRTIFDITNNLSIVIMALRPSDEGTYECVVLKYEKDAFKREHLAEVTLSVKAD

SEQ ID NO: 1131 - protein, 107 aa, Artificial Sequence
  CD80 v174 IgV
VIHVTKEVKEVATLSCGHNVSVEELPQTRIYWQKDKKMVLTMISGDMNIWPEYKNRTIFDITNNLSIVILALRPSDEGTYECVVQKYDKDAFKREHLAEVTLSVKAD

SEQ ID NO: 1132 - protein, 107 aa, Artificial Sequence
  CD80 v175 IgV
VIHVTKEVKEVATLSCGHNVSVEELAQTRIYWQKDKKMVLTMMSGVMNIWPEYKNRTIFDITNNLSIVILALRPSDEGTYECVVQKYEKDAFKREHLAEVTLSVKAD

SEQ ID NO: 1133 - protein, 107 aa, Artificial Sequence
  CD80 v176 IgV
VIHVTKEVKEVATLSCGHNVSVEELALTRIYWQKDKKMVLTMMSGDINIWPEYKNRIIFDITNNLSIVIQALRPSDEGTYECVVLKYDKDAFKREHLAEVTLSVKAD

SEQ ID NO: 1134 - protein, 107 aa, Artificial Sequence
  CD80 v177 IgV
VIHVTKEVKEVATLSCGHNVSVEELAQTRIYWQKEKKMVLTMMSGDVNIWPEYKNRTIFDITNNLSIVFLDLRPSDEGTYECIVLKYEKDAFKREHLAEVTLSVKAD

SEQ ID NO: 1135 - protein, 107 aa, Artificial Sequence
  CD80 v178 IgV
VIHVTKEVKEVATLSCGHNVSVEELAQTRIYWQKDKKMVLTMMSGDMNIWPEYKNRAIFDITNNLSIVILDLRPSDEGTYECVVQKYEKDAFKREHLAEVTLSVKAD

SEQ ID NO: 1136 - protein, 107 aa, Artificial Sequence
  CD80 v179 IgV
VIHVTKEVKEVATLSCGYNVSVEELTQTRIYWQKDKKMVLTMMSGDMNIWPEYKNRTIFDITNNLSIVILDLRPSDEGTYECVVQKYEKDAFKREHLAEVTLSVKAD

SEQ ID NO: 1137 - protein, 107 aa, Artificial Sequence
  CD80 v180 IgV
VIHVTKEVKEVATLSCGHNVSVEELAQTRIYWQKDKKMVLTMMSGDLNIWPEYKNRTIFDITNNLSIVILALRPSDEGTYECVVLKYEKDAFKREHLAEVTLSVKAD

SEQ ID NO: 1138 - protein, 107 aa, Artificial Sequence
  CD80 v181 IgV
VIHVTKEVKEVATLSCGHNVSVDELAQTRIYWQKEKKMVLTVISGDMNIWPEYKNRTVFDITNNLSIVIRALRPSDEGTYECVVLKYEKDAFKREHLAEVTLSVKAD

SEQ ID NO: 1139 - protein, 107 aa, Artificial Sequence
  CD80 v182 IgV
VIHVTKEVKEVATLSCGHNVSVEELAQTRIYWQKEKKMVLTMMSGDMNIWPEYKNRTIFDITNNLSIMIMDLRPSDEGTYECVVLKYEKDAFKRKHLAEVTLSVKAD

SEQ ID NO: 1140 - protein, 107 aa, Artificial Sequence
  CD80 v183 IgV
VIHVTKEVKEVATLSCGHNVSVEELAQTRIYWQKEKKMVLTMMSGDMNIWPEYKIRIIFDITNNLSIVFLALRPSDEGTYECVVLKYEKDAFKREHLAEVTLSVKAD

SEQ ID NO: 1141 - protein, 107 aa, Artificial Sequence
  CD80 v184 IgV
VIHVTKEVKEVATLSCGHNVSVEELAQTRIYWQKDKKMVLTMISGDMNIWPEYKNRTIFDITNNLSIVILDLRPSDEGTYECVVLKYEKDAFKREHLAEVTLSVKAD

SEQ ID NO: 1142 - protein, 107 aa, Artificial Sequence
  CD80 v185 IgV
VIHVTKEVKEVATLSCGHNVSVEELAQTRIYWQKEKKMVLSMMSGDMNIWPEYKNRIIFDITNNLSIVIRALRPSDEGTYECVVLKYEKDAFKREHLAEVTLSVKAD

SEQ ID NO: 1143 - protein, 107 aa, Artificial Sequence
  CD80 v186 IgV
VIHVTKEVKEVATLSCGYNVSVEELAQTRIYWQKEKKMVLTMMSGDMNIWPEYKNRTIFDITNNLSIVILDPRPSDEGTYECVVLKYVKDAFKREHLAEVTLSVKAD

SEQ ID NO: 1144 - protein, 107 aa, Artificial Sequence
  CD80 v187 IgV
VIHVTKEVKEVATLSCGHNISVEELAQTRIYWQKEKKMVLTMMSGDMNIWPEYKNRTIFDITNNLSIVILDLRPSDEGTYECVVLKYEKDAFKREHLAEVTLSVKAD

SEQ ID NO: 1145 - protein, 107 aa, Artificial Sequence
  CD80 v188 IgV
VIHVTKEVKEVATLSCGHNVSVGELSQTRIYWQKDKKMVLTMMSGDMNIWPEYKNRTIFDINNNLSIVILDVRPSDEGTYECVVMKYEKDAFKREHLAEVTLSVKAD

SEQ ID NO: 1146 - protein, 107 aa, Artificial Sequence
  CD80 v189 IgV
VIHVTKEVKEVTTLSCGHNVSVEDLAQTRIYWQKDKKMVLTMMSGVMNIWPEYKNRTIFDVTNNLSIVILAPRPSDEGTYECVVLKYEKDAFKRVHLAEVTLSVKAD

SEQ ID NO: 1147 - protein, 107 aa, Artificial Sequence
  CD80 v190 IgV
VIHVTKEVKEVATLSCGHNVSLEELAQTRIYWQKDKKMVLTMLSGDMNIWPEYKNRTIFDITNNLSIVILGLRPSHEGTYECVVLKYEKDAFKREHLAEVTLSVKAD

SEQ ID NO: 1148 - protein, 107 aa, Artificial Sequence
  CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVTLSVKAD

SEQ ID NO: 1149 - protein, 107 aa, Artificial Sequence
  CD80 v192 IgV
VIHVTKEVKEVATLSCGHNVSVEELAQTRIYWQKEKKMVLTMMSGDMNIWPEYKNRTIFDITNNLSIVIQDLRPSDEGTYECVVLKYEKDAFKREHLAEVTLSVKAD

SEQ ID NO: 1150 - protein, 107 aa, Artificial Sequence
  CD80 v193 IgV
VIHVTKEVKEVATLSCGHNVSVEELEQTRIYWQKDKKMVLTMMSGDLNIWPEYKNRTIFDITNNLSIVILALRPSDEGTYECVVQKYEKDAFKREHLAEVTLSVKAD

SEQ ID NO: 1151 - protein, 107 aa, Artificial Sequence
  CD80 v194 IgV
VIHVTKEVKEVATLSCGHNVSVEELAQTRIYWQKEKKMVLTMMSGEMNIWPEYKNRTIFDITNNLSIVILDLRPSDEGTYECVVLKYEKDAFKREHLAEVTLSVKAD

SEQ ID NO: 1152 - protein, 107 aa, Artificial Sequence
  CD80 v195 IgV
VIHVTKEVKEVATLSCGHNVSVEELAQTRIHWQKDKKMVLSMMSGDMNIWPEYKNRTIFDITNNLSILILALRPSDEGTYECVVLKYEKDAFRWEHLAEVTLSVKAD

SEQ ID NO: 1153 - protein, 232 aa, Artificial Sequence
  Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1154 - protein, 232 aa, Artificial Sequence
  Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 1155 - protein, 232 aa, Artificial Sequence
  Stack Fc (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1156 - protein, 8 aa, Artificial Sequence
  Stuffer
HMSSVSAQ

SEQ ID NO: 1157 - protein, 232 aa, Artificial Sequence
  Fc (C5S (C220S), R77C, (R292C),  N82G (N297G), V87C (V302C))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1158 - protein, 232 aa, Artificial Sequence
  Fc with C220S/L234A/L235E/G237A
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1159 - protein, 231 aa, Artificial Sequence
  Fc with C220S/E233P/L234V/L235A/G236del/S267K
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1160 - protein, 431 aa, Artificial Sequence
  antiCD19z chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1161 - protein, 21 aa, Artificial Sequence
  CD8-derived signal sequence
MALPVTALLLPLALLLHAARP

SEQ ID NO: 1162 - protein, 23 aa, Artificial Sequence
  CD8-derived signal sequence
MALPVTALLLPLALLLHAARPGS

SEQ ID NO: 1163 - protein, 245 aa, Artificial Sequence
  anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 1164 - protein, 69 aa, Artificial Sequence
  CD8-derived hinge and transmembrane domain
AKPTTTPAPRPPTPAPTIASQPLSLRPEACRPAAGGAVHTRGLDFACDIYIWAPLAGTCGVLLLSLVIT

SEQ ID NO: 1165 - protein, 42 aa, Artificial Sequence
  4-1BB-derived costimulatory domain
KRGRKKLLYIFKQPFMRPVQTTQEEDGCSCRFPEEEEGGCEL

SEQ ID NO: 1166 - protein, 40 aa, Artificial Sequence
  CD28-derived costimulatory domain
SKRSRLLHSDYMNMTPRRPGPTRKHYQPYAPPRDFAAYRS

SEQ ID NO: 1167 - protein, 41 aa, Artificial Sequence
  CD28-derived costimulatory domain
RSKRSRLLHSDYMNMTPRRPGPTRKHYQPYAPPRDFAAYRS

SEQ ID NO: 1168 - protein, 44 aa, Artificial Sequence
  CD28-derived costimulatory domain
FWVRSKRSRLLHSDYMNMTPRRPGPTRKHYQPYAPPRDFAAYRS

SEQ ID NO: 1169 - protein, 20 aa, Artificial Sequence
  T2A protein
SGEGRGSLLTCGDVEENPGP

SEQ ID NO: 1170 - protein, 232 aa, Artificial Sequence
  Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 1171 - protein, 472 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1172 - protein, 497 aa, Artificial Sequence
  2nd Gen CAR
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSR

SEQ ID NO: 1173 - protein, 471 aa, Artificial Sequence
  2nd Gen CAR with CD28-derived costimulatory domain
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1174 - protein, 248 aa, Artificial Sequence
  Anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAA

SEQ ID NO: 1175 - DNA, 1356 bp, Artificial Sequence
  antiCD19x8z chimeric antigen receptor nucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagcggccgcaaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 1176 - DNA, 63 bp, Artificial Sequence
  T2A Nucleotide
ggcagtggcgagggcagaggaagtctgctaacatgcggtgacgtcgaggagaatcctggccca

SEQ ID NO: 1177 - protein, 21 aa, Artificial Sequence
  T2A Protein
GSGEGRGSLLTCGDVEENPGP

SEQ ID NO: 1178 - protein, 117 aa, Artificial Sequence
  NKp30 v1 ECD
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLG

SEQ ID NO: 1179 - protein, 117 aa, Artificial Sequence
  NKp30 v2 ECD
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 1180 - protein, 117 aa, Artificial Sequence
  NKp30 v3 ECD
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLVVEKEHPQLG

SEQ ID NO: 1181 - protein, 117 aa, Artificial Sequence
  NKp30 v4 ECD
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLVVEKEHPQLG

SEQ ID NO: 1182 - protein, 117 aa, Artificial Sequence
  NKp30 v5 ECD
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLVVEKEHPQLG

SEQ ID NO: 1183 - protein, 108 aa, Artificial Sequence
  NKp30 WT IgC-like
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLV

SEQ ID NO: 1184 - protein, 108 aa, Artificial Sequence
  NKp30 v1 IgC-like
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLV

SEQ ID NO: 1185 - protein, 108 aa, Artificial Sequence
  NKp30 v2 IgC-like
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLV

SEQ ID NO: 1186 - protein, 108 aa, Artificial Sequence
  NKp30 v3 IgC-like
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLV

SEQ ID NO: 1187 - protein, 108 aa, Artificial Sequence
  NKp30 v4 IgC-like
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLV

SEQ ID NO: 1188 - protein, 108 aa, Artificial Sequence
  NKp30 v5 IgC-like
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLV

SEQ ID NO: 1189 - protein, 270 aa, Artificial Sequence
  Nkp30 stack
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGGSGGGGSAAAEPK

SEQ ID NO: 1190 - protein, 116 aa, Artificial Sequence
  NKp30 v1 IgC-like (long)
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQL

SEQ ID NO: 1191 - protein, 224 aa, Artificial Sequence
  CD86 v1 ECD
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1192 - protein, 224 aa, Artificial Sequence
  CD86 v2 ECD
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1193 - protein, 224 aa, Artificial Sequence
  CD86 v3 ECD
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1194 - protein, 224 aa, Artificial Sequence
  CD86 v4 ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 1195 - protein, 108 aa, Artificial Sequence
  CD86 WT IgV
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELS

SEQ ID NO: 1196 - protein, 108 aa, Artificial Sequence
  CD86 v1 IgV
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELS

SEQ ID NO: 1197 - protein, 108 aa, Artificial Sequence
  CD86 v2 IgV
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELS

SEQ ID NO: 1198 - protein, 108 aa, Artificial Sequence
  CD86 v3 IgV
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELS

SEQ ID NO: 1199 - protein, 108 aa, Artificial Sequence
  CD86 v4 IgV
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELS

SEQ ID NO: 1200 - protein, 229 aa, artificial sequence
  IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1201 - protein, 229 aa, Artificial Sequence
  IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1202 - protein, 232 aa, artificial Sequence
  IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1203 - protein, 98 aa, Artificial Sequence
  PD-L2 IgV
FTVTVPKELYIIEHGSNVTLECNFDTGSHVNLGAITASLQKVENDTSPHRERATLLEEQLPLGKASFHIPQVQVRDEGQYQCIIIYGVAWDYKYLTLK

SEQ ID NO: 1204 - protein, 201 aa, Artificial Sequence
  PD-L2 ECD v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1205 - protein, 201 aa, Artificial Sequence
  PD-L2 ECD v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1206 - protein, 201 aa, Artificial Sequence
  PD-L2 ECD v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1207 - protein, 201 aa, Artificial Sequence
  PD-L2 ECD v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1208 - protein, 201 aa, Artificial Sequence
  PD-L2 ECD v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1209 - protein, 201 aa, Artificial Sequence
  PD-L2 ECD v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1210 - protein, 201 aa, Artificial Sequence
  PD-L2 ECD v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1211 - protein, 201 aa, Artificial Sequence
  PD-L2 ECD v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1212 - protein, 201 aa, Artificial Sequence
  PD-L2 ECD v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1213 - protein, 201 aa, Artificial Sequence
  PD-L2 ECD v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1214 - protein, 201 aa, Artificial Sequence
  PD-L2 ECD v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1215 - protein, 201 aa, Artificial Sequence
  PD-L2 ECD v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1216 - protein, 201 aa, Artificial Sequence
  PD-L2 ECD v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1217 - protein, 201 aa, Artificial Sequence
  PD-L2 ECD v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1218 - protein, 201 aa, Artificial Sequence
  PD-L2 ECD v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1219 - protein, 201 aa, Artificial Sequence
  PD-L2 ECD v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1220 - protein, 201 aa, Artificial Sequence
  PD-L2 ECD v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1221 - protein, 201 aa, Artificial Sequence
  PD-L2 ECD v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1222 - protein, 201 aa, Artificial Sequence; identical to SEQ ID NO: 1217
  PD-L2 ECD v19

SEQ ID NO: 1223 - protein, 201 aa, Artificial Sequence
  PD-L2 ECD v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1224 - protein, 201 aa, Artificial Sequence
  PD-L2 ECD v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1225 - protein, 201 aa, Artificial Sequence
  PD-L2 ECD v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1226 - protein, 201 aa, Artificial Sequence
  PD-L2 ECD v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1227 - protein, 201 aa, Artificial Sequence
  PD-L2 ECD v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1228 - protein, 201 aa, Artificial Sequence
  PD-L2 ECD v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1229 - protein, 201 aa, Artificial Sequence
  PD-L2 ECD v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1230 - protein, 201 aa, Artificial Sequence
  PD-L2 ECD v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1231 - protein, 201 aa, Artificial Sequence
  PD-L2 ECD v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1232 - protein, 201 aa, Artificial Sequence
  PD-L2 ECD v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1233 - protein, 201 aa, Artificial Sequence
  PD-L2 ECD v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1234 - protein, 201 aa, Artificial Sequence
  PD-L2 ECD v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1235 - protein, 201 aa, Artificial Sequence
  PD-L2 ECD v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1236 - protein, 201 aa, Artificial Sequence
  PD-L2 ECD v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1237 - protein, 201 aa, Artificial Sequence
  PD-L2 ECD v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1238 - protein, 201 aa, Artificial Sequence
  PD-L2 ECD v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1239 - protein, 201 aa, Artificial Sequence
  PD-L2 ECD v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1240 - protein, 201 aa, Artificial Sequence
  PD-L2 ECD v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1241 - protein, 201 aa, Artificial Sequence
  PD-L2 ECD v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1242 - protein, 201 aa, Artificial Sequence
  PD-L2 ECD v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1243 - protein, 201 aa, Artificial Sequence
  PD-L2 ECD v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1244 - protein, 201 aa, Artificial Sequence
  PD-L2 ECD v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1245 - protein, 201 aa, Artificial Sequence
  PD-L2 ECD v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1246 - protein, 201 aa, Artificial Sequence
  PD-L2 ECD v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1247 - protein, 201 aa, Artificial Sequence
  PD-L2 ECD v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1248 - protein, 201 aa, Artificial Sequence
  PD-L2 ECD v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1249 - protein, 201 aa, Artificial Sequence
  PD-L2 ECD v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1250 - protein, 201 aa, Artificial Sequence
  PD-L2 ECD v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1251 - protein, 201 aa, Artificial Sequence
  PD-L2 ECD v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1252 - protein, 201 aa, Artificial Sequence
  PD-L2 ECD v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1253 - protein, 201 aa, Artificial Sequence
  PD-L2 ECD v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1254 - protein, 201 aa, Artificial Sequence
  PD-L2 ECD v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1255 - protein, 201 aa, Artificial Sequence
  PD-L2 ECD v52
  VARIANT (65)..(65): X is unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1256 - protein, 201 aa, Artificial Sequence
  PD-L2 ECD v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1257 - protein, 201 aa, Artificial Sequence
  PD-L2 ECD v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1258 - protein, 201 aa, Artificial Sequence
  PD-L2 ECD v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1259 - protein, 201 aa, Artificial Sequence
  PD-L2 ECD v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1260 - protein, 201 aa, Artificial Sequence
  PD-L2 ECD v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1261 - protein, 201 aa, Artificial Sequence
  PD-L2 ECD v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1262 - protein, 201 aa, Artificial Sequence
  PD-L2 ECD v59
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1263 - protein, 102 aa, Homo sapiens
  MISC_FEATURE: PD-L2 IgV wildtype
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 1264 - protein, 201 aa, Artificial Sequence
  PD-L2 ECD v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1265 - protein, 201 aa, Artificial Sequence
  PD-L2 ECD v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1266 - protein, 201 aa, Artificial Sequence
  PD-L2 ECD v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1267 - protein, 201 aa, Artificial Sequence
  PD-L2 ECD v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1268 - protein, 201 aa, Artificial Sequence
  PD-L2 ECD v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1269 - protein, 201 aa, Artificial Sequence
  PD-L2 ECD v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1270 - protein, 201 aa, Artificial Sequence
  PD-L2 ECD v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1271 - protein, 201 aa, Artificial Sequence
  PD-L2 ECD v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1272 - protein, 201 aa, Artificial Sequence
  PD-L2 ECD v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1273 - protein, 201 aa, Artificial Sequence
  PD-L2 ECD v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1274 - protein, 201 aa, Artificial Sequence
  PD-L2 ECD v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1275 - protein, 201 aa, Artificial Sequence
  PD-L2 ECD v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1276 - protein, 201 aa, Artificial Sequence
  PD-L2 ECD v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1277 - protein, 201 aa, Artificial Sequence
  PD-L2 ECD v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1278 - protein, 201 aa, Artificial Sequence
  PD-L2 ECD v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1279 - protein, 201 aa, Artificial Sequence
  PD-L2 ECD v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1280 - protein, 201 aa, Artificial Sequence
  PD-L2 ECD v77
LFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 1281 - protein, 98 aa, Artificial Sequence
  PD-L2 IgV v1
FTVTVPKELYIIEQGSNVTLECNFDTGSHVNLGAITASLQKVENDTSPHRERATLLEEQLPLGKASFHIPQVQVRDEGQYQCIIIYGVAWDYKYLTLK

SEQ ID NO: 1282 - protein, 98 aa, Artificial Sequence
  PD-L2 IgV v2
FTVTVPKELYIIEHGSNVTLECDFDTGSHVNLGAITASLQKVENDTSPHRERATLLEEQLPLGKASFHIPQVQVRDEGQYQCIIIYGVAWDYKYLTLK

SEQ ID NO: 1283 - protein, 98 aa, Artificial Sequence
  PD-L2 IgV v3
FTVTVPKELYIIEHGSNVTLECNFDTGSHVNLGAITASLQKVDNDTSPHRERATLLEEQLPLGKASFHIPQVQVRDEGQYQCIIIYGVAWDYKYLTLK

SEQ ID NO: 1284 - protein, 98 aa, Artificial Sequence
  PD-L2 IgV v4
FTVTVPKELYIIEHGSNVTLECNFDTGSHVNLGAITASLQKVENDTSPHRERATLLEEQLPLGKASFHIPQVQVRDEGQYQCIIIYGDAWDYKYLTLK

SEQ ID NO: 1285 - protein, 98 aa, Artificial Sequence
  PD-L2 IgV v5
FTVTVPKELYIIEHGSNVTLECNFDTGSHVNLGAITASLQKVENDTSPHRERATLLEEQLPLGKASFHIPQVQVRDEGQYRCIIIYGDAWDYKYLTLK

SEQ ID NO: 1286 - protein, 98 aa, Artificial Sequence
  PD-L2 IgV v6
FTVTVPKELYIIEHGSNVTLECNFDTGSHVNLGAITASLQKVENDTSPHRERATLLEGQLPLGKASFHIPQVQVRDEGQYRCIIIYGVAWDYKYLTLK

SEQ ID NO: 1287 - protein, 98 aa, Artificial Sequence
  PD-L2 IgV v7
FTVTVPKELYIIEHGSNVTLECNFDTGSHVNLGAITAILQKVENDTSPHRERATLLEEQLPLGKASFHIPQVQVRDEGQYQCIIIYGDAWDYKYLTLK

SEQ ID NO: 1288 - protein, 98 aa, Artificial Sequence
  PD-L2 IgV v8
FTVTVPKELYIIEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 1289 - protein, 98 aa, Artificial Sequence
  PD-L2 IgV v9
FTVTVPKELYIIEHGSNVTLECNFDTGSHVNLGAITASLQKVENDTSPHRERATLLEEQLPLGKALFHIPQVQVRDEGQYQCIFIYGVAWDYKYLTLK

SEQ ID NO: 1290 - protein, 98 aa, Artificial Sequence
  PD-L2 IgV v10
FTVTVPKELYIIEHGSNVTLECNFDTGSHVNLGAITASLQKVENDTSPHRERATLLEEQLPLGKALFHIPQVQVRDEGQYQCIITYGVAWDYKYLTLK

SEQ ID NO: 1291 - protein, 98 aa, Artificial Sequence
  PD-L2 IgV v11
FTVTVPKELYIIEQGSNVTLECNFDTGSHVNLGAITASLQKVENDTSPHRERATLLEEQLPLGRASFHIPQVQVRDEGQYQCIIIYGVAWDYKYLTLK

SEQ ID NO: 1292 - protein, 98 aa, Artificial Sequence
  PD-L2 IgV v12
FTVTVPKELYIIEQGSNVTLECNFDTGSHVNLGAITASLQKVENDTSPHRERATLLEEQLPLGKASFHIPHVQVRDEGQYQCIIIYGDAWDYKYLTLK

SEQ ID NO: 1293 - protein, 98 aa, Artificial Sequence
  PD-L2 IgV v13
FTVTVPKELYIIEQGSNVTLECNFDTGSHVNLGAITASLQKVENDTSPHRERATLLEEQLPLGKALFHIPQVQVGDEGQYQCIIIYGVAWDYKYLTLK

SEQ ID NO: 1294 - protein, 98 aa, Artificial Sequence
  PD-L2 IgV v14
FTVTVPKELYIIEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 1295 - protein, 98 aa, Artificial Sequence
  PD-L2 IgV v15
FTVTVPKELYIIEQGSNVTLECNFDTGSHVNLGAITASLQKVENDASPHRERATLLEEQLPLGKASFHIPQVQVRDEGQYRCIIIYGVAWDYKYLTLK

SEQ ID NO: 1296 - protein, 98 aa, Artificial Sequence
  PD-L2 IgV v16
FTVTVPKELYIIEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 1297 - protein, 98 aa, Artificial Sequence
  PD-L2 IgV v17
FTVTVPKELYIIEQGSNVTLESNFDTGSHVNLGAITASLQKVENDTSPHRERATLLEEQLPLGKASFHIPQVQVRDEGQYQCIITYGVAWDYKYLTLK

SEQ ID NO: 1298 - protein, 98 aa, Artificial Sequence
  PD-L2 IgV v18
FTVTVPKELYIIEQGSNVTLECNFDTGSHVNLGAITAILQKVENDTSPHRERATLLEEQLPLGKASFHIPQVQVRDEGQYQCIITYGVAWDYKYLTLK

SEQ ID NO: 1299 - protein, 98 aa, Artificial Sequence; identical to SEQ ID NO: 1294
  PD-L2 IgV v19

SEQ ID NO: 1300 - protein, 98 aa, Artificial Sequence
  PD-L2 IgV v20
FTVTVPKELYIIEHGSNVTLECNFDTGSHVNLGAITASLQKVDNDTSPHRERATLLEEQLPLGKASFHIPQVQVRDEGQYQCIIIYGDARDYKYLTLK

SEQ ID NO: 1301 - protein, 98 aa, Artificial Sequence
  PD-L2 IgV v21
FTVTVPKELYIVEHGSNVTLECNFDTGSHVNLGAITASLQKVENDTSPHRERATLLEEQLPLGKALFHIPQVQVRDEGQYQCIIIYGDAWDYKYLTLK

SEQ ID NO: 1302 - protein, 98 aa, Artificial Sequence
  PD-L2 IgV v22
FTVTVPKELYIIEQGSNVTLECNFDTGSHVNLGAITASLQKVENDTSPHRERATLLEEQLPLGKALFHIPQVQVRDEGQYQCIITYGVAWDYKYLTLK

SEQ ID NO: 1303 - protein, 98 aa, Artificial Sequence
  PD-L2 IgV v23
FTVTVPKELYIVEQGSNVTLECNFDTGSHVNLGAITASLQKVENDTSPHRERATLLEEQLPLGKALFHIPQVQVRDEGQYQCIITYGVAWDYKYLTLK

SEQ ID NO: 1304 - protein, 98 aa, Artificial Sequence
  PD-L2 IgV v24
FTVTVPKELYIVEQGSNVTLECNFDTGSHVNLGAITASLQKVDNDTSPHRERATLLEEQLPLGKASFHIPQVQVRDEGQYQCIIIYGDAWDYKYLTLK

SEQ ID NO: 1305 - protein, 98 aa, Artificial Sequence
  PD-L2 IgV v25
FTVTVPKELYIVEHGSNVTLECNFDTGSHVNLGAITAILQKVDNDTSPHRERATLLEEQLPLGKASFHIPQVQVRDEGQYRCIIIYGDAWDYKYLTLK

SEQ ID NO: 1306 - protein, 98 aa, Artificial Sequence
  PD-L2 IgV v26
FTVTVPKELYIVEHGSNVTLECNFDTGSHVNLGAITASLQKVDNDTSPHRERATLLEEQLPLGKASFHIPQVQVRDEGQYRCIIIYGDAWDYKYLTLK

SEQ ID NO: 1307 - protein, 98 aa, Artificial Sequence
  PD-L2 IgV v27
FTVTVPKELYIVEHGSNVTLECNFDTGSHVNLGAITASLQKVENDTSPHRERATLLEEQLPLGKASFHIPHVQVGDEGQYQCIITYGVAWDYKYLTLK

SEQ ID NO: 1308 - protein, 98 aa, Artificial Sequence
  PD-L2 IgV v28
FTVTVPKELYIVEQGSNVTLECNFDTGSHVNLGAITASLQKVENDTSPHRERATLLEEQLPLGKASFHIPQVQVGDEGQYQCIFIYGVAWDYKYLTLK

SEQ ID NO: 1309 - protein, 98 aa, Artificial Sequence
  PD-L2 IgV v29
FTVTVPKELYIIEQGSNVTLECNFDTGSHVNLGAITAILQKVENDTSPHRERATLLEEQLPLGKASFHIPQVQVGDEGQYQCIIIYGDAWDYKYLTLK

SEQ ID NO: 1310 - protein, 98 aa, Artificial Sequence
  PD-L2 IgV v30
FTVTVPKELYIIEQGSNVTLECNFDTGSHVNLGAITASLQKVENDTSPHRERATLLEEQLPLGKALFHIPQVQVGDEGQYQCIFIYGVAWDYKYLTLK

SEQ ID NO: 1311 - protein, 98 aa, Artificial Sequence
  PD-L2 IgV v31
FTVTVPKELYIIEQGSNVTLECNFDTGSHVNLGAITASLQKVENDASPHRERATLLEEQLPLGKASFHIPHVQVGDEGQYQCIITYGVAWDYKYLTLK

SEQ ID NO: 1312 - protein, 98 aa, Artificial Sequence
  PD-L2 IgV v32
FTVTVPKELYIIEQGSNVTLECNFDTGSHVNLGAITASLQKVENDASPHRERATLLEEQLPLGKASFHIPHVQVGDEGQYQCIIIYGVAWDYKYLTLK

SEQ ID NO: 1313 - protein, 98 aa, Artificial Sequence
  PD-L2 IgV v33
FTVTVPKELYIVEQGSNVTLECNFDTGSHVNLGAITASLQKVENDASPHRERATLLEEQLPLGKASFHIPHVQVGDEGQYQCIIIYGVAWDYKYLTLK

SEQ ID NO: 1314 - protein, 98 aa, Artificial Sequence
  PD-L2 IgV v34
FTVTVPKELYIIEQGSNVTLECNFDTGSHVNLGAITASLQKVDNDTSPHRERATLLEEQLPLGKASFHIPQVQVGDEGQYQCIFIYGVAWDYKYLTLK

SEQ ID NO: 1315 - protein, 98 aa, Artificial Sequence
  PD-L2 IgV v35
FTVTVPKELYIIEQGSNVTLECNFDTGSHVNLGAITAILQKVENDTSPHRERATLLEEQLPLGKALFHIPQVQVRDEGQYQCIIIYGDAWDYKYLTLK

SEQ ID NO: 1316 - protein, 98 aa, Artificial Sequence
  PD-L2 IgV v36
FTVTVPKELYIIEQGSNVTLECNFDTGSHVDLGAITASLQKVENDTSPHRERATLLEEQLPLGKALFHIPQVQVRDEGQYQCIIIYGDAWDYKYLTLK

SEQ ID NO: 1317 - protein, 98 aa, Artificial Sequence
  PD-L2 IgV v37
FTVTVPKELYIIEHGSNVTLECNFDTGSHVDLGAITASLQKVENDTSPHRERATLLEEQLPLGKALFHIPQVQVRDEGQYQCIIIYGDAWDYKYLTLK

SEQ ID NO: 1318 - protein, 98 aa, Artificial Sequence
  PD-L2 IgV v38
FTVTVPKELYIIEQGSNVTLECNFDTGSHVNLGAITASLQKVENDTSPHRERATLLEEQLPLGKALFHIPHVQVGDEGQYQCIIIYGDAWDYKYLTLK

SEQ ID NO: 1319 - protein, 98 aa, Artificial Sequence
  PD-L2 IgV v39
FTVTVPKELYIIEQGSNVTLECNFDTGSHVNLGAITASLQKVENDTSPHRERATLLEEQLPLGKASFHIPHVRVGDEGQYQCIITYGVAWDYKYLTLK

SEQ ID NO: 1320 - protein, 98 aa, Artificial Sequence
  PD-L2 IgV v40
FTVTVPKELYIIEHGSNVTLECNFDTVSHVNLGAITASLQKVENDTSPHRERATLLEEQLPLGKASFHIPHVQVGDEGQYQCIITYGVAWDYKYLTLK

SEQ ID NO: 1321 - protein, 98 aa, Artificial Sequence
  PD-L2 IgV v41
FTVTVPKELYIVEQGSNVTLECNFDTGSHVNLGAITAILQKVDNDTSPHRERATLLEEQLPLGKALFHIPQVQVRDEGQYQCIIIYGVAWDYKYLTLK

SEQ ID NO: 1322 - protein, 98 aa, Artificial Sequence
  PD-L2 IgV v42
FTVTVPKELYIIEHGSNVTLECNFDTGSHVNLGAITASLQKVDNDTSPHRERATLLEEQLPLGKALFHIPHVQVRDEGQYRCIIIYGDAWDYKYLTLK

SEQ ID NO: 1323 - protein, 98 aa, Artificial Sequence
  PD-L2 IgV v43
FTVTVPKELYIIEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 1324 - protein, 98 aa, Artificial Sequence
  PD-L2 IgV v44
FTVTVPKELYIIEQGSNVTLECNFDTGSHVNLGAITASLQKVENDASPHRERATLLEEQLPLGKASFHIPQVQVRDEGQYQCIIIYGVAWDYKYLTLK

SEQ ID NO: 1325 - protein, 98 aa, Artificial Sequence
  PD-L2 IgV v45
FTVTVPKELYIVEQGSNVTLECNFDTGSHVNLGAITASLQKVENDTSPHRERATLLEEQLPLGKASFHIPQVQVRDEGQYRCIIIYGVAWDYKYLTLK

SEQ ID NO: 1326 - protein, 98 aa, Artificial Sequence
  PD-L2 IgV v46
FTVTVPKELYIVEQGSNVTLECNFDTGSHVNLGAITASLQKVENDTSPHRERATLLEEQLPLGKASFHIPQVQVRDEGQYQCIIIYGDAWDYKYLTLK

SEQ ID NO: 1327 - protein, 98 aa, Artificial Sequence
  PD-L2 IgV v47
FTVTVPKELYIVEHGSNVTLECNFDTGSHVNLGAITASLQKVENDTSPHRERATLLEEQLPLGKALFHIPQVQVRDEGQYRCIIIYGDAWDYKYLTLK

SEQ ID NO: 1328 - protein, 98 aa, Artificial Sequence
  PD-L2 IgV v48
FTVTVPKELYIVEQGSNVTLECNFDTGSHVNLGAITASLQKVENDTSPHRERATLLEEQLPLGKASFHIPQVQVRDEGQYRCIIIYGDAWDYKYLTLK

SEQ ID NO: 1329 - protein, 98 aa, Artificial Sequence
  PD-L2 IgV v49
FTVTVPKELYIIEQGSNVTLECNFDTGSHMNLGAITASLQKVENDTSPHRERATLLEEQLPLGKALFHIPQVQVRDEGQYRCIIIYGDAWDYKYLTLK

SEQ ID NO: 1330 - protein, 98 aa, Artificial Sequence
  PD-L2 IgV v50
FTVTVPKELYIVEQGSNVTLECNFDTGSHVNLGAITASLQKVENDASPHRERATLLEEQLPLGKASFHIPQVQVRDEGQYRCIIIYGVAWDYKYLTLK

SEQ ID NO: 1331 - protein, 98 aa, Artificial Sequence
  PD-L2 IgV v51
FTVTVPKELYIVEQGSNVTLECNFDTGSHANLGAITASLQKVESDTSPHRERATLLEEQLPLGKASFHIPQVQVRDEGQYRCIIIYGDAWDYKYLTLK

SEQ ID NO: 1332 - protein, 98 aa, Artificial Sequence
  PD-L2 IgV v52
  VARIANT (64)..(64): X is unknown
FTVTVPKELYIVEHGSNVALECNFDTGSHVNLGAITASLQKVENDASPHRERATLLEEQLPLGXASFHIPQVQVRDEGQYRCIIIYGDAWDYKYLTLK

SEQ ID NO: 1333 - protein, 98 aa, Artificial Sequence
  PD-L2 IgV v53
FTVTVPKELYIIEQGSNVTLECNFDTGSHVNLGAITASLQKVENDASPHRERATLLEEQLPLGKASFLIPQVQVRDEGQYRCIIIYGDAWDYKYLTLK

SEQ ID NO: 1334 - protein, 98 aa, Artificial Sequence
  PD-L2 IgV v54
FTVTVPKELYIVEQGSNVTLECNFDTGSHVNLGAITASLQKVENDASPHRERATLLEEQLPLGKASFLIPQVQVGDEGQYQCIIIYGDAWDYKYLTLK

SEQ ID NO: 1335 - protein, 98 aa, Artificial Sequence
  PD-L2 IgV v55
FTVTVPKELYVVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 1336 - protein, 98 aa, Artificial Sequence
  PD-L2 IgV v56
FTVTVPKELYIVEQGSNVTLECNFDTGSHVNLGAITASLQKVENDTSPHRERATLLEEQLPLGKASFHIPQVQVGNEGQYRCIIIYGDAWDYKYLTLK

SEQ ID NO: 1337 - protein, 98 aa, Artificial Sequence
  PD-L2 IgV v57
FTVTVPKELYIVEQGSNVTLECNFDTGSHVNLGAITASLQKVENDASPHRERATLLEEQLPLGKASFHIPQVQVGDEGQYQCIIIYGDAWDYKYLTLK

SEQ ID NO: 1338 - protein, 98 aa, Artificial Sequence
  PD-L2 IgV v58
FTVTVPKELYIVEQGSNVTLECNFDTGSHVNLGAITASLQKVENDASPHRERATLLEEQLPLGKASFHIPQVQVRDEGQYRCIIIYGDAWDYKYLTLK

SEQ ID NO: 1339 - protein, 98 aa, Artificial Sequence
  PD-L2 IgV v60
FTVTVPKELYIVEQGSNVTLECDFDTGSHVNLGAITASLQKVENDTSPHRERATLLEEQLPLGKASFHIPQVQVRDEGQYRCIIIYGDAWDYKYLTLK

SEQ ID NO: 1340 - protein, 98 aa, Artificial Sequence
  PD-L2 IgV v61
FTVTVPKELYIVEQGSNVTLECNFDTGSHVNLGAVTASLQKVENDASPHRERATLLEEQLPLGKALFHIPQVQVRDEGQYQCIIIYGDAWDYKYLTLK

SEQ ID NO: 1341 - protein, 98 aa, Artificial Sequence
  PD-L2 IgV v62
FTVTVPKELYIIEQGSNVTLECNFDTGSHVNLGAITASLQKVENDASPHRERATLLEEQLPLGRALFHIPQVQVRDEGQYRCIIIYGDAWDYKYLTLK

SEQ ID NO: 1342 - protein, 98 aa, Artificial Sequence
  PD-L2 IgV v63
FTVTVPKELYIIEQGSNVTLECNFDTGSHVNPGAITASLQKVENDASPHRERATLLEEQLPLGKALFHISQVQVRDEGQYQCIIIYGDAWDYKYLTLK

SEQ ID NO: 1343 - protein, 98 aa, Artificial Sequence
  PD-L2 IgV v64
FTVTVPKELYIVEQGSNVTLECNFDTGSHVNLGAITASLQKVENDTSPHRERATLLEEQLPLGKASFHIPHVQVGDEGQYQCIITYGVAWDYKYLTLK

SEQ ID NO: 1344 - protein, 98 aa, Artificial Sequence
  PD-L2 IgV v65
FTVTVPKELYIIEQGSNVTLECNFDTGSHVNLGAITASLQKVENDASPHRERATLLEEQLPLGKALFHIPQVQVRDEGQYRCIIIYGDAWDYKYLTLK

SEQ ID NO: 1345 - protein, 98 aa, Artificial Sequence
  PD-L2 IgV v66
LTVTVPKELYIIEQGSNVTLECNFDTGSHVNLGAITASLQKVENEASPHRERATLLEEQLPLGKASFHIPHVQVGDEGQYRCIIIYGDAWDYKYLTLK

SEQ ID NO: 1346 - protein, 98 aa, Artificial Sequence
  PD-L2 IgV v67
FTVTVPKELYIVEQGSNVTLECNFDTGSHVNFGAITASLQKVENDASPHRERATLLEEQLPLGKASFHIPQVQVRDEGQYRCIIIYGDAWDYKYLTLK

SEQ ID NO: 1347 - protein, 98 aa, Artificial Sequence
  PD-L2 IgV v68
FTVTVPKELYIVEQGSNVTLECNFDTGSHVNLGAITASLQKVENDASPHRERATLLGEQLPLGKALFHIPQVQVRDEGQYRCIIIYGDAWDYKYLTLK

SEQ ID NO: 1348 - protein, 98 aa, Artificial Sequence
  PD-L2 IgV v69
FTVTVPKELYIIEQGSNVTLECSFDTGSHVNLGAITASLQKVENDASPHRERATLLEEQLPLGKASFHIPHVQVGDEGQYQCIIIYGDAWDYKYLTLK

SEQ ID NO: 1349 - protein, 98 aa, Artificial Sequence
  PD-L2 IgV v70
FTVTVPKELYIVEQGSNVTLECNFDTGSHVNLGAITASLQKVVNDASPHRERATLLEEQLPLGKASFHIPQVQVRDEGQYRCIIIYGDAWDYKYLTLK

SEQ ID NO: 1350 - protein, 98 aa, Artificial Sequence
  PD-L2 IgV v71
FTVTVPKELYIIEQGSDVTLECNFDTGSHVNLGAITASLQKVENDASPHRERATLLEEQLPLGKASFHIPHAQVGDEGQYQCIITYGDAWDYKYLTLK

SEQ ID NO: 1351 - protein, 98 aa, Artificial Sequence
  PD-L2 IgV v72
FTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLK

SEQ ID NO: 1352 - protein, 98 aa, Artificial Sequence
  PD-L2 IgV v73
FTVTVPKELYIIEQGSNVTLECNFDTGSHVNHGAITASLQKVENDTSPHRERATLLEEQLPLGKALFHIPQVQVGDEGQYRCIIIYGDAWDYKYLTLK

SEQ ID NO: 1353 - protein, 98 aa, Artificial Sequence
  PD-L2 IgV v74
FTVTVPKELYIVEQGSNVTLECNFDTGSHVNLGAITASLQKVENDASPHRERATLLEEQLPLGKASFHIPHVQVGDEGQYQCIITYGVAWDYKYLTLK

SEQ ID NO: 1354 - protein, 98 aa, Artificial Sequence
  PD-L2 IgV v75
FTVTVPKELYIIEQGSNVTLECNFDTGSHVNLGAITAILQKVDNDTSPHRERATLLEEQLPLGKASFHIPHVQGGDEGQYRCIIIYGDAWDYKYLTLK

SEQ ID NO: 1355 - protein, 98 aa, Artificial Sequence
  PD-L2 IgV v76
FTVTVPKELYIIEQGSNVTLECNFDTGSHVNLGAITASLQKVENDASPHRERATLLEEQLPLGKALFHIPQVQVGDEGQYRCIIIYGDAWDYKYLTLK

SEQ ID NO: 1356 - protein, 98 aa, Artificial Sequence
  PD-L2 IgV v77
FTVTVPKELYIVEQGSNVTLECNFDTGSHVNLGAITASLQKVENDASPHRERATLLEEQLPLGKALFHIPHVQVGDEGQYRCIIIYGDAWDYKYLTLK

SEQ ID NO: 1357 - protein, 102 aa, Artificial Sequence
  PD-L2 IgV v1
LFTVTVPKELYIIEQGSNVTLECNFDTGSHVNLGAITASLQKVENDTSPHRERATLLEEQLPLGKASFHIPQVQVRDEGQYQCIIIYGVAWDYKYLTLKVKA

SEQ ID NO: 1358 - protein, 102 aa, Artificial Sequence
  PD-L2 IgV v2
LFTVTVPKELYIIEHGSNVTLECDFDTGSHVNLGAITASLQKVENDTSPHRERATLLEEQLPLGKASFHIPQVQVRDEGQYQCIIIYGVAWDYKYLTLKVKA

SEQ ID NO: 1359 - protein, 102 aa, Artificial Sequence
  PD-L2 IgV v3
LFTVTVPKELYIIEHGSNVTLECNFDTGSHVNLGAITASLQKVDNDTSPHRERATLLEEQLPLGKASFHIPQVQVRDEGQYQCIIIYGVAWDYKYLTLKVKA

SEQ ID NO: 1360 - protein, 102 aa, Artificial Sequence
  PD-L2 IgV v4
LFTVTVPKELYIIEHGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 1361 - protein, 102 aa, Artificial Sequence
  PD-L2 IgV v5
LFTVTVPKELYIIEHGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 1362 - protein, 102 aa, Artificial Sequence
  PD-L2 IgV v6
LFTVTVPKELYIIEHGSNVTLECNFDTGSHVNLGAITASLQKVENDTSPHRERATLLEGQLPLGKASFHIPQVQVRDEGQYRCIIIYGVAWDYKYLTLKVKA

SEQ ID NO: 1363 - protein, 102 aa, Artificial Sequence
  PD-L2 IgV v7
LFTVTVPKELYIIEHGSNVTLECNFDTGSHVNLGAITAILQKVENDTSPHRERATLLEEQLPLGKASFHIPQVQVRDEGQYQCIIIYGDAWDYKYLTLKVKA

SEQ ID NO: 1364 - protein, 102 aa, Artificial Sequence
  PD-L2 IgV v8
LFTVTVPKELYIIEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 1365 - protein, 102 aa, Artificial Sequence
  PD-L2 IgV v9
LFTVTVPKELYIIEHGSNVTLECNFDTGSHVNLGAITASLQKVENDTSPHRERATLLEEQLPLGKALFHIPQVQVRDEGQYQCIFIYGVAWDYKYLTLKVKA

SEQ ID NO: 1366 - protein, 102 aa, Artificial Sequence
  PD-L2 IgV v10
LFTVTVPKELYIIEHGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 1367 - protein, 102 aa, Artificial Sequence
  PD-L2 IgV v11
LFTVTVPKELYIIEQGSNVTLECNFDTGSHVNLGAITASLQKVENDTSPHRERATLLEEQLPLGRASFHIPQVQVRDEGQYQCIIIYGVAWDYKYLTLKVKA

SEQ ID NO: 1368 - protein, 102 aa, Artificial Sequence
  PD-L2 IgV v12
LFTVTVPKELYIIEQGSNVTLECNFDTGSHVNLGAITASLQKVENDTSPHRERATLLEEQLPLGKASFHIPHVQVRDEGQYQCIIIYGDAWDYKYLTLKVKA

SEQ ID NO: 1369 - protein, 102 aa, Artificial Sequence
  PD-L2 IgV v13
LFTVTVPKELYIIEQGSNVTLECNFDTGSHVNLGAITASLQKVENDTSPHRERATLLEEQLPLGKALFHIPQVQVGDEGQYQCIIIYGVAWDYKYLTLKVKA

SEQ ID NO: 1370 - protein, 102 aa, Artificial Sequence
  PD-L2 IgV v14
LFTVTVPKELYIIEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 1371 - protein, 102 aa, Artificial Sequence
  PD-L2 IgV v15
LFTVTVPKELYIIEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 1372 - protein, 102 aa, Artificial Sequence
  PD-L2 IgV v16
LFTVTVPKELYIIEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 1373 - protein, 102 aa, Artificial Sequence
  PD-L2 IgV v17
LFTVTVPKELYIIEQGSNVTLESNFDTGSHVNLGAITASLQKVENDTSPHRERATLLEEQLPLGKASFHIPQVQVRDEGQYQCIITYGVAWDYKYLTLKVKA

SEQ ID NO: 1374 - protein, 102 aa, Artificial Sequence
  PD-L2 IgV v18
LFTVTVPKELYIIEQGSNVTLECNFDTGSHVNLGAITAILQKVENDTSPHRERATLLEEQLPLGKASFHIPQVQVRDEGQYQCIITYGVAWDYKYLTLKVKA

SEQ ID NO: 1375 - protein, 102 aa, Artificial Sequence; identical to SEQ ID NO: 1370
  PD-L2 IgV v19

SEQ ID NO: 1376 - protein, 102 aa, Artificial Sequence
  PD-L2 IgV v20
LFTVTVPKELYIIEHGSNVTLECNFDTGSHVNLGAITASLQKVDNDTSPHRERATLLEEQLPLGKASFHIPQVQVRDEGQYQCIIIYGDARDYKYLTLKVKA

SEQ ID NO: 1377 - protein, 102 aa, Artificial Sequence
  PD-L2 IgV v21
LFTVTVPKELYIVEHGSNVTLECNFDTGSHVNLGAITASLQKVENDTSPHRERATLLEEQLPLGKALFHIPQVQVRDEGQYQCIIIYGDAWDYKYLTLKVKA

SEQ ID NO: 1378 - protein, 102 aa, Artificial Sequence
  PD-L2 IgV v22
LFTVTVPKELYIIEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 1379 - protein, 102 aa, Artificial Sequence
  PD-L2 IgV v23
LFTVTVPKELYIVEQGSNVTLECNFDTGSHVNLGAITASLQKVENDTSPHRERATLLEEQLPLGKALFHIPQVQVRDEGQYQCIITYGVAWDYKYLTLKVKA

SEQ ID NO: 1380 - protein, 102 aa, Artificial Sequence
  PD-L2 IgV v24
LFTVTVPKELYIVEQGSNVTLECNFDTGSHVNLGAITASLQKVDNDTSPHRERATLLEEQLPLGKASFHIPQVQVRDEGQYQCIIIYGDAWDYKYLTLKVKA

SEQ ID NO: 1381 - protein, 102 aa, Artificial Sequence
  PD-L2 IgV v25
LFTVTVPKELYIVEHGSNVTLECNFDTGSHVNLGAITAILQKVDNDTSPHRERATLLEEQLPLGKASFHIPQVQVRDEGQYRCIIIYGDAWDYKYLTLKVKA

SEQ ID NO: 1382 - protein, 102 aa, Artificial Sequence
  PD-L2 IgV v26
LFTVTVPKELYIVEHGSNVTLECNFDTGSHVNLGAITASLQKVDNDTSPHRERATLLEEQLPLGKASFHIPQVQVRDEGQYRCIIIYGDAWDYKYLTLKVKA

SEQ ID NO: 1383 - protein, 102 aa, Artificial Sequence
  PD-L2 IgV v27
LFTVTVPKELYIVEHGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 1384 - protein, 102 aa, Artificial Sequence
  PD-L2 IgV v28
LFTVTVPKELYIVEQGSNVTLECNFDTGSHVNLGAITASLQKVENDTSPHRERATLLEEQLPLGKASFHIPQVQVGDEGQYQCIFIYGVAWDYKYLTLKVKA

SEQ ID NO: 1385 - protein, 102 aa, Artificial Sequence
  PD-L2 IgV v29
LFTVTVPKELYIIEQGSNVTLECNFDTGSHVNLGAITAILQKVENDTSPHRERATLLEEQLPLGKASFHIPQVQVGDEGQYQCIIIYGDAWDYKYLTLKVKA

SEQ ID NO: 1386 - protein, 102 aa, Artificial Sequence
  PD-L2 IgV v30
LFTVTVPKELYIIEQGSNVTLECNFDTGSHVNLGAITASLQKVENDTSPHRERATLLEEQLPLGKALFHIPQVQVGDEGQYQCIFIYGVAWDYKYLTLKVKA

SEQ ID NO: 1387 - protein, 102 aa, Artificial Sequence
  PD-L2 IgV v31
LFTVTVPKELYIIEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 1388 - protein, 102 aa, Artificial Sequence
  PD-L2 IgV v32
LFTVTVPKELYIIEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 1389 - protein, 102 aa, Artificial Sequence
  PD-L2 IgV v33
LFTVTVPKELYIVEQGSNVTLECNFDTGSHVNLGAITASLQKVENDASPHRERATLLEEQLPLGKASFHIPHVQVGDEGQYQCIIIYGVAWDYKYLTLKVKA

SEQ ID NO: 1390 - protein, 102 aa, Artificial Sequence
  PD-L2 IgV v34
LFTVTVPKELYIIEQGSNVTLECNFDTGSHVNLGAITASLQKVDNDTSPHRERATLLEEQLPLGKASFHIPQVQVGDEGQYQCIFIYGVAWDYKYLTLKVKA

SEQ ID NO: 1391 - protein, 102 aa, Artificial Sequence
  PD-L2 IgV v35
LFTVTVPKELYIIEQGSNVTLECNFDTGSHVNLGAITAILQKVENDTSPHRERATLLEEQLPLGKALFHIPQVQVRDEGQYQCIIIYGDAWDYKYLTLKVKA

SEQ ID NO: 1392 - protein, 102 aa, Artificial Sequence
  PD-L2 IgV v36
LFTVTVPKELYIIEQGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 1393 - protein, 102 aa, Artificial Sequence
  PD-L2 IgV v37
LFTVTVPKELYIIEHGSNVTLECNFDTGSHVDLGAITASLQKVENDTSPHRERATLLEEQLPLGKALFHIPQVQVRDEGQYQCIIIYGDAWDYKYLTLKVKA

SEQ ID NO: 1394 - protein, 102 aa, Artificial Sequence
  PD-L2 IgV v38
LFTVTVPKELYIIEQGSNVTLECNFDTGSHVNLGAITASLQKVENDTSPHRERATLLEEQLPLGKALFHIPHVQVGDEGQYQCIIIYGDAWDYKYLTLKVKA

SEQ ID NO: 1395 - protein, 102 aa, Artificial Sequence
  PD-L2 IgV v39
LFTVTVPKELYIIEQGSNVTLECNFDTGSHVNLGAITASLQKVENDTSPHRERATLLEEQLPLGKASFHIPHVRVGDEGQYQCIITYGVAWDYKYLTLKVKA

SEQ ID NO: 1396 - protein, 102 aa, Artificial Sequence
  PD-L2 IgV v40
LFTVTVPKELYIIEHGSNVTLECNFDTVSHVNLGAITASLQKVENDTSPHRERATLLEEQLPLGKASFHIPHVQVGDEGQYQCIITYGVAWDYKYLTLKVKA

SEQ ID NO: 1397 - protein, 102 aa, Artificial Sequence
  PD-L2 IgV v41
LFTVTVPKELYIVEQGSNVTLECNFDTGSHVNLGAITAILQKVDNDTSPHRERATLLEEQLPLGKALFHIPQVQVRDEGQYQCIIIYGVAWDYKYLTLKVKA

SEQ ID NO: 1398 - protein, 102 aa, Artificial Sequence
  PD-L2 IgV v42
LFTVTVPKELYIIEHGSNVTLECNFDTGSHVNLGAITASLQKVDNDTSPHRERATLLEEQLPLGKALFHIPHVQVRDEGQYRCIIIYGDAWDYKYLTLKVKA

SEQ ID NO: 1399 - protein, 102 aa, Artificial Sequence
  PD-L2 IgV v43
LFTVTVPKELYIIEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 1400 - protein, 102 aa, Artificial Sequence
  PD-L2 IgV v44
LFTVTVPKELYIIEQGSNVTLECNFDTGSHVNLGAITASLQKVENDASPHRERATLLEEQLPLGKASFHIPQVQVRDEGQYQCIIIYGVAWDYKYLTLKVKA

SEQ ID NO: 1401 - protein, 102 aa, Artificial Sequence
  PD-L2 IgV v45
LFTVTVPKELYIVEQGSNVTLECNFDTGSHVNLGAITASLQKVENDTSPHRERATLLEEQLPLGKASFHIPQVQVRDEGQYRCIIIYGVAWDYKYLTLKVKA

SEQ ID NO: 1402 - protein, 102 aa, Artificial Sequence
  PD-L2 IgV v46
LFTVTVPKELYIVEQGSNVTLECNFDTGSHVNLGAITASLQKVENDTSPHRERATLLEEQLPLGKASFHIPQVQVRDEGQYQCIIIYGDAWDYKYLTLKVKA

SEQ ID NO: 1403 - protein, 102 aa, Artificial Sequence
  PD-L2 IgV v47
LFTVTVPKELYIVEHGSNVTLECNFDTGSHVNLGAITASLQKVENDTSPHRERATLLEEQLPLGKALFHIPQVQVRDEGQYRCIIIYGDAWDYKYLTLKVKA

SEQ ID NO: 1404 - protein, 102 aa, Artificial Sequence
  PD-L2 IgV v48
LFTVTVPKELYIVEQGSNVTLECNFDTGSHVNLGAITASLQKVENDTSPHRERATLLEEQLPLGKASFHIPQVQVRDEGQYRCIIIYGDAWDYKYLTLKVKA

SEQ ID NO: 1405 - protein, 102 aa, Artificial Sequence
  PD-L2 IgV v49
LFTVTVPKELYIIEQGSNVTLECNFDTGSHMNLGAITASLQKVENDTSPHRERATLLEEQLPLGKALFHIPQVQVRDEGQYRCIIIYGDAWDYKYLTLKVKA

SEQ ID NO: 1406 - protein, 102 aa, Artificial Sequence
  PD-L2 IgV v50
LFTVTVPKELYIVEQGSNVTLECNFDTGSHVNLGAITASLQKVENDASPHRERATLLEEQLPLGKASFHIPQVQVRDEGQYRCIIIYGVAWDYKYLTLKVKA

SEQ ID NO: 1407 - protein, 102 aa, Artificial Sequence
  PD-L2 IgV v51
LFTVTVPKELYIVEQGSNVTLECNFDTGSHANLGAITASLQKVESDTSPHRERATLLEEQLPLGKASFHIPQVQVRDEGQYRCIIIYGDAWDYKYLTLKVKA

SEQ ID NO: 1408 - protein, 102 aa, Artificial Sequence
  PD-L2 IgV v52
  VARIANT (65)..(65): X is unknown
LFTVTVPKELYIVEHGSNVALECNFDTGSHVNLGAITASLQKVENDASPHRERATLLEEQLPLGXASFHIPQVQVRDEGQYRCIIIYGDAWDYKYLTLKVKA

SEQ ID NO: 1409 - protein, 102 aa, Artificial Sequence
  PD-L2 IgV v53
LFTVTVPKELYIIEQGSNVTLECNFDTGSHVNLGAITASLQKVENDASPHRERATLLEEQLPLGKASFLIPQVQVRDEGQYRCIIIYGDAWDYKYLTLKVKA

SEQ ID NO: 1410 - protein, 102 aa, Artificial Sequence
  PD-L2 IgV v54
LFTVTVPKELYIVEQGSNVTLECNFDTGSHVNLGAITASLQKVENDASPHRERATLLEEQLPLGKASFLIPQVQVGDEGQYQCIIIYGDAWDYKYLTLKVKA

SEQ ID NO: 1411 - protein, 102 aa, Artificial Sequence
  PD-L2 IgV v55
LFTVTVPKELYVVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 1412 - protein, 102 aa, Artificial Sequence
  PD-L2 IgV v56
LFTVTVPKELYIVEQGSNVTLECNFDTGSHVNLGAITASLQKVENDTSPHRERATLLEEQLPLGKASFHIPQVQVGNEGQYRCIIIYGDAWDYKYLTLKVKA

SEQ ID NO: 1413 - protein, 102 aa, Artificial Sequence
  PD-L2 IgV v57
LFTVTVPKELYIVEQGSNVTLECNFDTGSHVNLGAITASLQKVENDASPHRERATLLEEQLPLGKASFHIPQVQVGDEGQYQCIIIYGDAWDYKYLTLKVKA

SEQ ID NO: 1414 - protein, 102 aa, Artificial Sequence
  PD-L2 IgV v58
LFTVTVPKELYIVEQGSNVTLECNFDTGSHVNLGAITASLQKVENDASPHRERATLLEEQLPLGKASFHIPQVQVRDEGQYRCIIIYGDAWDYKYLTLKVKA

SEQ ID NO: 1415 - protein, 102 aa, Artificial Sequence
  PD-L2 IgV v60
LFTVTVPKELYIVEQGSNVTLECDFDTGSHVNLGAITASLQKVENDTSPHRERATLLEEQLPLGKASFHIPQVQVRDEGQYRCIIIYGDAWDYKYLTLKVKA

SEQ ID NO: 1416 - protein, 102 aa, Artificial Sequence
  PD-L2 IgV v61
LFTVTVPKELYIVEQGSNVTLECNFDTGSHVNLGAVTASLQKVENDASPHRERATLLEEQLPLGKALFHIPQVQVRDEGQYQCIIIYGDAWDYKYLTLKVKA

SEQ ID NO: 1417 - protein, 102 aa, Artificial Sequence
  PD-L2 IgV v62
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKA

SEQ ID NO: 1418 - protein, 102 aa, Artificial Sequence
  PD-L2 IgV v63
LFTVTVPKELYIIEQGSNVTLECNFDTGSHVNPGAITASLQKVENDASPHRERATLLEEQLPLGKALFHISQVQVRDEGQYQCIIIYGDAWDYKYLTLKVKA

SEQ ID NO: 1419 - protein, 102 aa, Artificial Sequence
  PD-L2 IgV v64
LFTVTVPKELYIVEQGSNVTLECNFDTGSHVNLGAITASLQKVENDTSPHRERATLLEEQLPLGKASFHIPHVQVGDEGQYQCIITYGVAWDYKYLTLKVKA

SEQ ID NO: 1420 - protein, 102 aa, Artificial Sequence
  PD-L2 IgV v65
LFTVTVPKELYIIEQGSNVTLECNFDTGSHVNLGAITASLQKVENDASPHRERATLLEEQLPLGKALFHIPQVQVRDEGQYRCIIIYGDAWDYKYLTLKVKA

SEQ ID NO: 1421 - protein, 102 aa, Artificial Sequence
  PD-L2 IgV v66
LLTVTVPKELYIIEQGSNVTLECNFDTGSHVNLGAITASLQKVENEASPHRERATLLEEQLPLGKASFHIPHVQVGDEGQYRCIIIYGDAWDYKYLTLKVKA

SEQ ID NO: 1422 - protein, 102 aa, Artificial Sequence
  PD-L2 IgV v67
LFTVTVPKELYIVEQGSNVTLECNFDTGSHVNFGAITASLQKVENDASPHRERATLLEEQLPLGKASFHIPQVQVRDEGQYRCIIIYGDAWDYKYLTLKVKA

SEQ ID NO: 1423 - protein, 102 aa, Artificial Sequence
  PD-L2 IgV v68
LFTVTVPKELYIVEQGSNVTLECNFDTGSHVNLGAITASLQKVENDASPHRERATLLGEQLPLGKALFHIPQVQVRDEGQYRCIIIYGDAWDYKYLTLKVKA

SEQ ID NO: 1424 - protein, 102 aa, Artificial Sequence
  PD-L2 IgV v69
LFTVTVPKELYIIEQGSNVTLECSFDTGSHVNLGAITASLQKVENDASPHRERATLLEEQLPLGKASFHIPHVQVGDEGQYQCIIIYGDAWDYKYLTLKVKA

SEQ ID NO: 1425 - protein, 102 aa, Artificial Sequence
  PD-L2 IgV v70
LFTVTVPKELYIVEQGSNVTLECNFDTGSHVNLGAITASLQKVVNDASPHRERATLLEEQLPLGKASFHIPQVQVRDEGQYRCIIIYGDAWDYKYLTLKVKA

SEQ ID NO: 1426 - protein, 102 aa, Artificial Sequence
  PD-L2 IgV v71
LFTVTVPKELYIIEQGSDVTLECNFDTGSHVNLGAITASLQKVENDASPHRERATLLEEQLPLGKASFHIPHAQVGDEGQYQCIITYGDAWDYKYLTLKVKA

SEQ ID NO: 1427 - protein, 102 aa, Artificial Sequence
  PD-L2 IgV v72
LFTVTVPKELYIVEQGSNVTLECNFDTGSHVNLGAIAASLQKVDNDTCPHRERATLLEEQLPLGKALFHIPQVQVRDEGQYRCIIIYGDAWDYKYLTLKVKA

SEQ ID NO: 1428 - protein, 102 aa, Artificial Sequence
  PD-L2 IgV v73
LFTVTVPKELYIIEQGSNVTLECNFDTGSHVNHGAITASLQKVENDTSPHRERATLLEEQLPLGKALFHIPQVQVGDEGQYRCIIIYGDAWDYKYLTLKVKA

SEQ ID NO: 1429 - protein, 102 aa, Artificial Sequence
  PD-L2 IgV v74
LFTVTVPKELYIVEQGSNVTLECNFDTGSHVNLGAITASLQKVENDASPHRERATLLEEQLPLGKASFHIPHVQVGDEGQYQCIITYGVAWDYKYLTLKVKA

SEQ ID NO: 1430 - protein, 102 aa, Artificial Sequence
  PD-L2 IgV v75
LFTVTVPKELYIIEQGSNVTLECNFDTGSHVNLGAITAILQKVDNDTSPHRERATLLEEQLPLGKASFHIPHVQGGDEGQYRCIIIYGDAWDYKYLTLKVKA

SEQ ID NO: 1431 - protein, 102 aa, Artificial Sequence
  PD-L2 IgV v76
LFTVTVPKELYIIEQGSNVTLECNFDTGSHVNLGAITASLQKVENDASPHRERATLLEEQLPLGKALFHIPQVQVGDEGQYRCIIIYGDAWDYKYLTLKVKA

SEQ ID NO: 1432 - protein, 102 aa, Artificial Sequence
  PD-L2 IgV v77
LFTVTVPKELYIVEQGSNVTLECNFDTGSHVNLGAITASLQKVENDASPHRERATLLEEQLPLGKALFHIPHVQVGDEGQYRCIIIYGDAWDYKYLTLKVKA

SEQ ID NO: 1433 - protein, 329 aa, Artificial sequence
  CD112 v89 ECD
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1434 - protein, 329 aa, Artificial sequence
  CD112 v90 ECD
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1435 - protein, 329 aa, Artificial sequence
  CD112 v91 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1436 - protein, 329 aa, Artificial sequence
  CD112 v92 ECD
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1437 - protein, 329 aa, Artificial sequence
  CD112 v93 ECD
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1438 - protein, 329 aa, Artificial sequence
  CD112 v94 ECD
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1439 - protein, 329 aa, Artificial sequence
  CD112 v95 ECD
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1440 - protein, 329 aa, Artificial sequence
  CD112 v96 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1441 - protein, 329 aa, Artificial sequence
  CD112 v97 ECD
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1442 - protein, 329 aa, Artificial sequence
  CD112 v98 ECD
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1443 - protein, 329 aa, Artificial sequence
  CD112 v99 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1444 - protein, 329 aa, Artificial sequence
  CD112 v100 ECD
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1445 - protein, 329 aa, Artificial sequence
  CD112 v101 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1446 - protein, 329 aa, Artificial sequence
  CD112 v102 ECD
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1447 - protein, 329 aa, Artificial sequence
  CD112 v103 ECD
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1448 - protein, 329 aa, Artificial sequence
  CD112 v104 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1449 - protein, 329 aa, Artificial sequence
  CD112 v105 ECD
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1450 - protein, 329 aa, Artificial sequence
  CD112 v106 ECD
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1451 - protein, 329 aa, Artificial sequence
  CD112 v107 ECD
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1452 - protein, 329 aa, Artificial sequence
  CD112 v108 ECD
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1453 - protein, 329 aa, Artificial sequence
  CD112 v109 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1454 - protein, 329 aa, Artificial sequence
  CD112 v100 ECD
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1455 - protein, 329 aa, Artificial sequence
  CD112 v111 ECD
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1456 - protein, 329 aa, Artificial sequence
  CD112 v112 ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 1457 - protein, 125 aa, Artificial sequence
  CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWL

SEQ ID NO: 1458 - protein, 125 aa, Artificial sequence
  CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWL

SEQ ID NO: 1459 - protein, 125 aa, Artificial sequence
  CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWL

SEQ ID NO: 1460 - protein, 125 aa, Artificial sequence
  CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWL

SEQ ID NO: 1461 - protein, 125 aa, Artificial sequence
  CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWL

SEQ ID NO: 1462 - protein, 125 aa, Artificial sequence
  CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWL

SEQ ID NO: 1463 - protein, 125 aa, Artificial sequence
  CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWL

SEQ ID NO: 1464 - protein, 125 aa, Artificial sequence
  CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWL

SEQ ID NO: 1465 - protein, 125 aa, Artificial sequence
  CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWL

SEQ ID NO: 1466 - protein, 125 aa, Artificial sequence
  CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWA

SEQ ID NO: 1467 - protein, 125 aa, Artificial sequence
  CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWL

SEQ ID NO: 1468 - protein, 125 aa, Artificial sequence
  CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWL

SEQ ID NO: 1469 - protein, 125 aa, Artificial sequence
  CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWL

SEQ ID NO: 1470 - protein, 125 aa, Artificial sequence
  CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWL

SEQ ID NO: 1471 - protein, 125 aa, Artificial sequence
  CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWL

SEQ ID NO: 1472 - protein, 125 aa, Artificial sequence
  CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWL

SEQ ID NO: 1473 - protein, 125 aa, Artificial sequence
  CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWL

SEQ ID NO: 1474 - protein, 125 aa, Artificial sequence
  CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWL

SEQ ID NO: 1475 - protein, 125 aa, Artificial sequence
  CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWL

SEQ ID NO: 1476 - protein, 125 aa, Artificial sequence
  CD112 v108 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWL

SEQ ID NO: 1477 - protein, 125 aa, Artificial sequence
  CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWL

SEQ ID NO: 1478 - protein, 125 aa, Artificial sequence
  CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWL

SEQ ID NO: 1479 - protein, 125 aa, Artificial sequence
  CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLL

SEQ ID NO: 1480 - protein, 125 aa, Artificial sequence
  CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWL

SEQ ID NO: 1481 - protein, 127 aa, Artificial sequence
  CD112 v89 IgV
QDVRVQVLPEVRGQLGGTVELPCHLLPPVPGLHISLVTWQRPDAPANHQNVAAFHPKMGPSFPSPKPGSERLSFVSAKQSTGKDTEAELQDATLALHGLTVEDEGNYTCEFVTFPKGTVRGMTWLRV

SEQ ID NO: 1482 - protein, 127 aa, Artificial sequence
  CD112 v90 IgV
QDVRVQVLPEVRGQLGGTVELPCHLLPPMPGLHISLVTWQRPDAPANHQNVAAFHPKMGPSFPSPKPGSERLSFVSAKQSTGQDTEAELQDATLALHGLTVEDEGIYTCEFATFPKGFVRGMTWLRV

SEQ ID NO: 1483 - protein, 127 aa, Artificial sequence
  CD112 v91 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGSVRGMTWLRV

SEQ ID NO: 1484 - protein, 127 aa, Artificial sequence
  CD112 v92 IgV
QDVRVQVLPEVRGQLGGTVELPCHLLPPVPGLHISLVTWQRPDAPANHQNVAAFHPKMGPSFPSPKPGSERLSFVSAKRSTGQDTEAELQDATLALHGLTVEDEGNYTCEFATFPKGFVRGMTWLRV

SEQ ID NO: 1485 - protein, 127 aa, Artificial sequence
  CD112 v93 IgV
QDVRVQVLPEVRGQLGGTVELPCHLLPPVPGLHISLVTWQRPDAPAKHQNVAAFHPKMGPSFPSPKPGSERLSLVSAKQSTGQDTEAELQDATLALHGLTVEDEGNYTCEFATFPKGFVRGMTWLRV

SEQ ID NO: 1486 - protein, 127 aa, Artificial sequence
  CD112 v94 IgV
QDVRVQVLPEVWGQLGGTVELPCHLLPPVPGLYISLVTWQRPDAPANHQNVAAFHPKMGPSFPSPKPGSERLSFVSAKQSTGQDTEAELQDATLALHGLTMEDEGIYTCEFATFPKGYVRGMTWLRV

SEQ ID NO: 1487 - protein, 127 aa, Artificial sequence
  CD112 v95 IgV
QDVRVQVLPEVRGQLGGTVELPCHLLPPVPGLYISLVTWQRPDAPTNHQNVAAFHPKMGPSFPSPKPGSERLSFVSAKQSTGQDTEAELQDATLALHGLTAEDEGIYTCEFATFPKGYVRGMTWLRV

SEQ ID NO: 1488 - protein, 127 aa, Artificial sequence
  CD112 v96 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGYYTCEFVTFPKGTVRGMTWLRV

SEQ ID NO: 1489 - protein, 127 aa, Artificial sequence
  CD112 v97 IgV
QDVRVQVLPEVRGQLGGTVELPCHLLPPVPGLYISLVTWQRPDAPANHQNVAAFHPKMGPSFPSPKPGSERLSFVPAKQSIGQDTEAELQDATLALHGLTMEDEGYYTCEFVTFPKGFVRGMTWLRV

SEQ ID NO: 1490 - protein, 127 aa, Artificial sequence
  CD112 v98 IgV
QDVRVQVLREVRGQLGGTVEVLCHLLPPVPGLYMSLVTWQRPDAPANHQNVAAFHPKMGPSFPSPKPGFERLSLVSAKQSTGQDTEVELQDATLALHGLTVEDEGNYTCEFVTFPKGSVRGMTWARV

SEQ ID NO: 1491 - protein, 127 aa, Artificial sequence
  CD112 v99 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGNYTCEFVTFPKGSVRGMTWLRV

SEQ ID NO: 1492 - protein, 127 aa, Artificial sequence
  CD112 v100 IgV
QDVRVQVLPEVRGQLGGTVELPCHLLPPAPGPYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1493 - protein, 127 aa, Artificial sequence
  CD112 v101 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTMEDEGIYTCEFVTFPKGSVRGMTWLRV

SEQ ID NO: 1494 - protein, 127 aa, Artificial sequence
  CD112 v102 IgV
QDVRVQVLPEVWGQLGGTVELPCHLLPPVPGLHISLVTWQRPDAPAKHQNVAAFHPKMGPSFPSPKPGSERLSFVSAKRSTGQDTEAELQDATLALHGLTVEDEGNYTCEFATFPKGYVRGMTWLRV

SEQ ID NO: 1495 - protein, 127 aa, Artificial sequence
  CD112 v103 IgV
QDVRVQVLPEVRGQLGGTVELPCHLLPPVPGLHISLVTWQRPDAPTNHQNVAAFHPKMGPSFPSPKPGSERLSFVSAKQSTGQDTEAELQDATLALHGLTVEDEGNYTCEFVTFPKGTVRGMTWLRV

SEQ ID NO: 1496 - protein, 127 aa, Artificial sequence
  CD112 v104 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTLPKGTVRGMTWLRV

SEQ ID NO: 1497 - protein, 127 aa, Artificial sequence
  CD112 v105 IgV
QDVRVQVLPEVRGQLGGTVELPCHLLPPVPGLHISLVAWQRPDAPTNHQNVAAFHPKMGPSFPSPKPGSERLSFVSAKQSTGQDTEAELQDATLALHGLTMEDEGNYTCEFVTFPKGSVRGMTWLRV

SEQ ID NO: 1498 - protein, 127 aa, Artificial sequence
  CD112 v106 IgV
QDVRVQVLPEVRGQLGGTVELPCHLLPSVPGLHISLVTWQRPDAPANHQNVAAFHPKMGPSFPSPKPGPERLSFVSAKQSTGQDTEAELQDATLALHGLTVEDEGIYTCEFVTFPKGYVRGMTWLRV

SEQ ID NO: 1499 - protein, 127 aa, Artificial sequence
  CD112 v107 IgV
QDVRVQVLPEVRGQLGGTVELPCHLLPPVPGLHISLVTWQRLDAPAKHQNVAAFHPKMGPSFPSPKPGSERLSFVSAKQSTGQDTEAELQDATLALHGLTMEDEGNYTCEFVTFPKGSVRGMTWLRV

SEQ ID NO: 1500 - protein, 127 aa, Artificial sequence
  CD112 v109 IgV
QDVRVQVLPEVRGQLGGTVELPCHLLPPVPGLHISLVTWQRPDAPAKHQNVAAFHPKMGPSFPSPKPGSERLSSVSAKQSTGKDTEAELQDATLALHGLTVEDEGIYTCELVTFPKGTVRGMTWLRV

SEQ ID NO: 1501 - protein, 127 aa, Artificial sequence
  CD112 v109 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGNYTCEFVTFPKGTARGMTWLRV

SEQ ID NO: 1502 - protein, 127 aa, Artificial sequence
  CD112 v100 IgV
QDVRVQVLPEVRGQLGGTVELPCHLLPPVPGLHISLVTWQRPDAPANHQNVAAFHPKMGPSFPSPKPGSERLSFVSAKQSTGQDTEAELQDATLALHGLTVEDEGIYTCEFVTFPKGFVRGMTWLRV

SEQ ID NO: 1503 - protein, 127 aa, Artificial sequence
  CD112 v111 IgV
QDVRVQVLPEVRGQLGGTVELPCHLLPPVPGLHISLVTWQRPDAPANHQNVAAFHPKMGPSFPSPMPGSERLSFVSAKQSTGQDTEAELQDATLALHGLTVEDEGNYTCEFATFPKGFVRGMTLLRV

SEQ ID NO: 1504 - protein, 127 aa, Artificial sequence
  CD112 v112 IgV
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGIYTCEFVTFPKGSVRGMTWLRV

SEQ ID NO: 1505 - protein, 116 aa, Artificial Sequence
  CD155 v120 IgV
PGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWL

SEQ ID NO: 1506 - protein, 116 aa, Artificial Sequence
  CD155 v121 IgV
PGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWL

SEQ ID NO: 1507 - protein, 116 aa, Artificial Sequence
  CD155 v122 IgV
PGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWL

SEQ ID NO: 1508 - protein, 116 aa, Artificial Sequence
  CD155 v123 IgV
PGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWL

SEQ ID NO: 1509 - protein, 116 aa, Artificial Sequence
  CD155 v124 IgV
PGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1510 - protein, 116 aa, Artificial Sequence
  CD155 v125 IgV
PGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWL

SEQ ID NO: 1511 - protein, 116 aa, Artificial Sequence
  CD155 v126 IgV
PGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWL

SEQ ID NO: 1512 - protein, 116 aa, Artificial Sequence
  CD155 v127 IgV
PGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWL

SEQ ID NO: 1513 - protein, 116 aa, Artificial Sequence
  CD155 v128 IgV
PGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWL

SEQ ID NO: 1514 - protein, 116 aa, Artificial Sequence
  CD155 v129 IgV
PGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWL

SEQ ID NO: 1515 - protein, 116 aa, Artificial Sequence
  CD155 v130 IgV
PGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWL

SEQ ID NO: 1516 - protein, 116 aa, Artificial Sequence
  CD155 v131 IgV
PGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWL

SEQ ID NO: 1517 - protein, 116 aa, Artificial Sequence
  CD155 v132 IgV
PGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWL

SEQ ID NO: 1518 - protein, 116 aa, Artificial Sequence
  CD155 v133 IgV
PGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWL

SEQ ID NO: 1519 - protein, 116 aa, Artificial Sequence
  CD155 v134 IgV
PGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWL

SEQ ID NO: 1520 - protein, 116 aa, Artificial Sequence
  CD155 v135 IgV
PGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWL

SEQ ID NO: 1521 - protein, 116 aa, Artificial Sequence
  CD155 v136 IgV
PGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWL

SEQ ID NO: 1522 - protein, 116 aa, Artificial Sequence
  CD155 v137 IgV
PGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWL

SEQ ID NO: 1523 - protein, 116 aa, Artificial Sequence
  CD155 v138 IgV
PGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWL

SEQ ID NO: 1524 - protein, 116 aa, Artificial Sequence
  CD155 v139 IgV
PGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWL

SEQ ID NO: 1525 - protein, 116 aa, Artificial Sequence
  CD155 v140 IgV
PGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWL

SEQ ID NO: 1526 - protein, 116 aa, Artificial Sequence
  CD155 v141 IgV
PGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWL

SEQ ID NO: 1527 - protein, 116 aa, Artificial Sequence
  CD155 v142 IgV
PGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWL

SEQ ID NO: 1528 - protein, 122 aa, Artificial Sequence
  CD155 v120 IgV
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVL

SEQ ID NO: 1529 - protein, 122 aa, Artificial Sequence
  CD155 v121 IgV
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVL

SEQ ID NO: 1530 - protein, 122 aa, Artificial Sequence
  CD155 v122 IgV
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVL

SEQ ID NO: 1531 - protein, 122 aa, Artificial Sequence
  CD155 v123 IgV
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVL

SEQ ID NO: 1532 - protein, 122 aa, Artificial Sequence
  CD155 v124 IgV
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1533 - protein, 122 aa, Artificial Sequence
  CD155 v125 IgV
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVL

SEQ ID NO: 1534 - protein, 122 aa, Artificial Sequence
  CD155 v126 IgV
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVL

SEQ ID NO: 1535 - protein, 122 aa, Artificial Sequence
  CD155 v127 IgV
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1536 - protein, 122 aa, Artificial Sequence
  CD155 v128 IgV
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVL

SEQ ID NO: 1537 - protein, 122 aa, Artificial Sequence
  CD155 v129 IgV
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVL

SEQ ID NO: 1538 - protein, 122 aa, Artificial Sequence
  CD155 v130 IgV
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVL

SEQ ID NO: 1539 - protein, 122 aa, Artificial Sequence
  CD155 v131 IgV
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVL

SEQ ID NO: 1540 - protein, 122 aa, Artificial Sequence
  CD155 v132 IgV
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVL

SEQ ID NO: 1541 - protein, 122 aa, Artificial Sequence
  CD155 v133 IgV
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVL

SEQ ID NO: 1542 - protein, 122 aa, Artificial Sequence
  CD155 v134 IgV
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVL

SEQ ID NO: 1543 - protein, 122 aa, Artificial Sequence
  CD155 v135 IgV
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVL

SEQ ID NO: 1544 - protein, 122 aa, Artificial Sequence
  CD155 v136 IgV
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVL

SEQ ID NO: 1545 - protein, 122 aa, Artificial Sequence
  CD155 v137 IgV
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVL

SEQ ID NO: 1546 - protein, 122 aa, Artificial Sequence
  CD155 v138 IgV
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVL

SEQ ID NO: 1547 - protein, 122 aa, Artificial Sequence
  CD155 v139 IgV
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVL

SEQ ID NO: 1548 - protein, 122 aa, Artificial Sequence
  CD155 v140 IgV
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVL

SEQ ID NO: 1549 - protein, 122 aa, Artificial Sequence
  CD155 v141 IgV
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVL

SEQ ID NO: 1550 - protein, 122 aa, Artificial Sequence
  CD155 v142 IgV
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVL

SEQ ID NO: 1551 - protein, 323 aa, Artificial Sequence
  CD155 v120 ECD
WPPPGTGDVVVQAPTQVSGFLGDSVTLPCYLQVPNMEVTHVSQLTWGRHGESGSMAVFHQTQGPSYSESKRLEFVAARPGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1552 - protein, 323 aa, Artificial Sequence
  CD155 v121 ECD
WPPPGTGDVVVQAPTQVTGFLGGAVTLPCYLQVPDMEVTHVSQLTWARLGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1553 - protein, 323 aa, Artificial Sequence
  CD155 v122 ECD
WPPPGTGDLVVQAPTQVSGFLGDSVTLPCYLQVPNMEVTHVSQLTWARHGESGSMAVFHRTQGPSYSESKRLEFLAARPGAELRNASLKMSGLRVEDEGNYTCEFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1554 - protein, 323 aa, Artificial Sequence
  CD155 v123 ECD
WPPPGTGDVVVQAPTQVSGFLGDSVTLPCYLQVPNMEVTHVSQLTWARRGESGSMAVFHQTQGPSYSESKRLDFVAARPGAELRDASLRMSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1555 - protein, 323 aa, Artificial Sequence
  CD155 v124 ECD
WPPPGTGDVVAQAPTQVSGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1556 - protein, 323 aa, Artificial Sequence
  CD155 v125 ECD
WPPPGTGDVVAQAPTQVSGFLGDSVTLPCYLQVPNMEVTHVSQLTWARHGESGRMAVFHPTKGPSYSESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1557 - protein, 323 aa, Artificial Sequence
  CD155 v126 ECD
WPPPGTGDVVVQAPTQVTGFLGDSVTLPCYLQVPNMEVTHVSQLTWARHGEPGSMAVFHQTQGPAYVESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1558 - protein, 323 aa, Artificial Sequence
  CD155 v127 ECD
WPPPGTGDVVVQAPTQVTGFLGDSVTLPCYLQVPNTEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1559 - protein, 323 aa, Artificial Sequence
  CD155 v128 ECD
WPPPGTGGVVVQAPTQVSGFLGDSVTLPCYLQVPNIEATHVSQLTWARQGESGSMAVFHQTQGPSYSESKRLEFVEARLGAELRNASLRMSGLRVEDEGNYTCMFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1560 - protein, 323 aa, Artificial Sequence
  CD155 v129 ECD
WPPPGTGDVVVQAPTQVSGFLGDSVTLPCYLQVPNMEVTHVSQLTWARHGEPGSMAVFHQTQGPAYVESKRLEFVAARPGAELRNASLRMSGLRVEDEGNYTCMFVSFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1561 - protein, 323 aa, Artificial Sequence
  CD155 v130 ECD
WPPPGTGDVVVQAPIQVTGFLGDSVTLPCYLQVPNMEVTHVSQLTWARHGESGSMAVFHQTQGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1562 - protein, 323 aa, Artificial Sequence
  CD155 v131 ECD
WPPPGTGDVVVQAPTQVFGFLGDSVMLPCYLQVPNMEVTHVSQVTWARHGESGSMAVFHQTKGPSYSESKRLEFVAARPGADLRNASLRMSGLRVEDEGNYTCMFVTFPQDSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1563 - protein, 323 aa, Artificial Sequence
  CD155 v132 ECD
WPPPGTGDVVVQAPTQVTGFLGDSVTLPCYLQVPNMGVTHVSQLTWARHGESRSMAVFHQTKGPSYSESKRLEFVAARPGAELRNASLRMSGLRVEDDGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1564 - protein, 323 aa, Artificial Sequence
  CD155 v133 ECD
WPPPGTGDVVVQAPTQVLGFLGDSVTLPCYLQVPNMEVTHVSQLTWARHGESGSMAVFHQTQGPSYSESERLEFVAARPGAELRNASLRMSGLRAEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1565 - protein, 323 aa, Artificial Sequence
  CD155 v134 ECD
WPPPGTGDIVVKAPTQVFGFLGDSVTLPCYLQVPNMEVTHVSQLTWARHGESGSMAVFHQTQGPAYVESKRLEFVAARPGAELRNASLRMFGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1566 - protein, 323 aa, Artificial Sequence
  CD155 v135 ECD
WPPPGTGDVVVQAPTQVFGFLGDSVTLPCYLQVPNMEVTHVSQLTWARHGESGSMAVFHQTQGPAYVESKRLEFVAARLGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1567 - protein, 323 aa, Artificial Sequence
  CD155 v136 ECD
WPPPGTGDIIVQAPTQVSGSLGDSVTLPCYLQVPNMEVTHVSQLAWARHGESGSMAVFHQTQGPSYSESKRLEFVAARPGAELRNASLRMSGLRVEDEGNYTCMFVTYPQRVRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1568 - protein, 323 aa, Artificial Sequence
  CD155 v137 ECD
WPPPGTGDLVVQAPTQVLGFLGDSVTLPCYLQVPNMEVTHVSQLTWARHGESGSMAVFHQTQGPSYSESKRLEFVAARPGAELRNASLRISGLRVEDEGNYSCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1569 - protein, 323 aa, Artificial Sequence
  CD155 v138 ECD
WPPPGTGDVVVQAPTQVCGFLGDSVMLPCYLQVPNMEVTHVSQVTWARHGESGSIAVFHQTKGPSYSESKRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1570 - protein, 323 aa, Artificial Sequence
  CD155 v139 ECD
WPPPGTGDIVVQAPTQVTGFLGGSVTLPCYLQVPNMEVTHVSQLTWARHGESGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1571 - protein, 323 aa, Artificial Sequence
  CD155 v140 ECD
WPPPGTGDVVVQAPTQVFGFLGDSVTLPCYLQVPNMEVTHVSQLTWARHGESGSMAVFHQTQGPSYSESKRLEFVAARPGAELRNASLRLSGLRAEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1572 - protein, 323 aa, Artificial Sequence
  CD155 v141 ECD
WPPPGTGDVVVQAPTQVTGFLGDSVTLPCYLQVPNTEVTHVSQLTWARHGESGSMAVFHQTQGPAYEESKRLEFVAARQGTELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1573 - protein, 323 aa, Artificial Sequence
  CD155 v142 ECD
WPPPGTGDLVVQAPTQVTGFLGDSVTLPCYLQVPNMEVTHVSQLTWARHGESGSMAVFHQTRGPSYSESKRLEFVAARPGAELRNASLRMSGLRVEDEGNYTCMFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1574 - protein, 323 aa, Artificial Sequence
  CD155 v143 ECD
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1575 - protein, 116 aa, Artificial Sequence
  CD155 v143 IgV
PGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWL

SEQ ID NO: 1576 - protein, 122 aa, Artificial Sequence
  CD155 v143 IgV
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1577 - protein, 323 aa, Artificial Sequence
  CD155 v144 ECD
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1578 - protein, 323 aa, Artificial Sequence
  CD155 v145 ECD
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1579 - protein, 323 aa, Artificial Sequence
  CD155 v146 ECD
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1580 - protein, 323 aa, Artificial Sequence
  CD155 v147 ECD
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1581 - protein, 323 aa, Artificial Sequence
  CD155 v148 ECD
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1582 - protein, 323 aa, Artificial Sequence
  CD155 v149 ECD
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1583 - protein, 323 aa, Artificial Sequence
  CD155 v150 ECD
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1584 - protein, 323 aa, Artificial Sequence
  CD155 v151 ECD
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1585 - protein, 323 aa, Artificial Sequence
  CD155 v152 ECD
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1586 - protein, 323 aa, Artificial Sequence
  CD155 v153 ECD
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1587 - protein, 323 aa, Artificial Sequence
  CD155 v154 ECD
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1588 - protein, 323 aa, Artificial Sequence
  CD155 v155 ECD
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1589 - protein, 323 aa, Artificial Sequence
  CD155 v156 ECD
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1590 - protein, 323 aa, Artificial Sequence
  CD155 v157 ECD
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1591 - protein, 323 aa, Artificial Sequence
  CD155 v158 ECD
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1592 - protein, 323 aa, Artificial Sequence
  CD155 v159 ECD
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1593 - protein, 323 aa, Artificial Sequence
  CD155 v160 ECD
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1594 - protein, 323 aa, Artificial Sequence
  CD155 v161 ECD
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1595 - protein, 323 aa, Artificial Sequence
  CD155 v162 ECD
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1596 - protein, 323 aa, Artificial Sequence
  CD155 v163 ECD
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1597 - protein, 323 aa, Artificial Sequence
  CD155 v164 ECD
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1598 - protein, 323 aa, Artificial Sequence
  CD155 v165 ECD
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1599 - protein, 323 aa, Artificial Sequence
  CD155 v166 ECD
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1600 - protein, 323 aa, Artificial Sequence
  CD155 v167 ECD
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1601 - protein, 323 aa, Artificial Sequence
  CD155 v168 ECD
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1602 - protein, 323 aa, Artificial Sequence
  CD155 v169 ECD
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1603 - protein, 323 aa, Artificial Sequence
  CD155 v170 ECD
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1604 - protein, 323 aa, Artificial Sequence
  CD155 v171 ECD
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1605 - protein, 323 aa, Artificial Sequence
  CD155 v172 ECD
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1606 - protein, 323 aa, Artificial Sequence
  CD155 v173 ECD
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1607 - protein, 323 aa, Artificial Sequence
  CD155 v174 ECD
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1608 - protein, 323 aa, Artificial Sequence
  CD155 v175 ECD
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1609 - protein, 323 aa, Artificial Sequence
  CD155 v176 ECD
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1610 - protein, 323 aa, Artificial Sequence
  CD155 v177 ECD
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1611 - protein, 323 aa, Artificial Sequence
  CD155 v178 ECD
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1612 - protein, 323 aa, Artificial Sequence
  CD155 v179 ECD
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1613 - protein, 323 aa, Artificial Sequence
  CD155 v180 ECD
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1614 - protein, 323 aa, Artificial Sequence
  CD155 v181 ECD
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1615 - protein, 323 aa, Artificial Sequence
  CD155 v182 ECD
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1616 - protein, 323 aa, Artificial Sequence
  CD155 v183 ECD
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1617 - protein, 323 aa, Artificial Sequence
  CD155 v184 ECD
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1618 - protein, 323 aa, Artificial Sequence
  CD155 v185 ECD
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1619 - protein, 323 aa, Artificial Sequence
  CD155 v186 ECD
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1620 - protein, 323 aa, Artificial Sequence
  CD155 v187 ECD
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1621 - protein, 323 aa, Artificial Sequence
  CD155 v188 ECD
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1622 - protein, 323 aa, Artificial Sequence
  CD155 v189 ECD
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 1623 - protein, 116 aa, Artificial Sequence
  CD155 v144 IgV
PGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWL

SEQ ID NO: 1624 - protein, 116 aa, Artificial Sequence
  CD155 v145 IgV
PGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWL

SEQ ID NO: 1625 - protein, 116 aa, Artificial Sequence
  CD155 v146 IgV
PGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWL

SEQ ID NO: 1626 - protein, 116 aa, Artificial Sequence
  CD155 v147 IgV
PGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWL

SEQ ID NO: 1627 - protein, 116 aa, Artificial Sequence
  CD155 v148 IgV
PGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWL

SEQ ID NO: 1628 - protein, 116 aa, Artificial Sequence
  CD155 v149 IgV
PGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWL

SEQ ID NO: 1629 - protein, 116 aa, Artificial Sequence
  CD155 v150 IgV
PGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWL

SEQ ID NO: 1630 - protein, 116 aa, Artificial Sequence
  CD155 v151 IgV
PGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWL

SEQ ID NO: 1631 - protein, 116 aa, Artificial Sequence
  CD155 v152 IgV
PGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWL

SEQ ID NO: 1632 - protein, 116 aa, Artificial Sequence
  CD155 v153 IgV
PGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWL

SEQ ID NO: 1633 - protein, 116 aa, Artificial Sequence
  CD155 v154 IgV
PGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWL

SEQ ID NO: 1634 - protein, 116 aa, Artificial Sequence
  CD155 v155 IgV
PGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWL

SEQ ID NO: 1635 - protein, 116 aa, Artificial Sequence
  CD155 v156 IgV
PGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWL

SEQ ID NO: 1636 - protein, 116 aa, Artificial Sequence
  CD155 v157 IgV
PGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWL

SEQ ID NO: 1637 - protein, 116 aa, Artificial Sequence
  CD155 v158 IgV
PGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWL

SEQ ID NO: 1638 - protein, 116 aa, Artificial Sequence
  CD155 v159 IgV
PGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWL

SEQ ID NO: 1639 - protein, 116 aa, Artificial Sequence
  CD155 v160 IgV
PGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWL

SEQ ID NO: 1640 - protein, 116 aa, Artificial Sequence
  CD155 v161 IgV
PGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWL

SEQ ID NO: 1641 - protein, 116 aa, Artificial Sequence
  CD155 v162 IgV
PGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWL

SEQ ID NO: 1642 - protein, 116 aa, Artificial Sequence
  CD155 v163 IgV
PGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWL

SEQ ID NO: 1643 - protein, 116 aa, Artificial Sequence
  CD155 v164 IgV
PGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWL

SEQ ID NO: 1644 - protein, 116 aa, Artificial Sequence
  CD155 v165 IgV
PGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWL

SEQ ID NO: 1645 - protein, 116 aa, Artificial Sequence
  CD155 v166 IgV
PGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWL

SEQ ID NO: 1646 - protein, 116 aa, Artificial Sequence
  CD155 v167 IgV
PGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWL

SEQ ID NO: 1647 - protein, 116 aa, Artificial Sequence
  CD155 v168 IgV
PGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWL

SEQ ID NO: 1648 - protein, 116 aa, Artificial Sequence
  CD155 v169 IgV
PGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWL

SEQ ID NO: 1649 - protein, 116 aa, Artificial Sequence
  CD155 v170 IgV
PGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWL

SEQ ID NO: 1650 - protein, 116 aa, Artificial Sequence
  CD155 v171 IgV
PGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWL

SEQ ID NO: 1651 - protein, 116 aa, Artificial Sequence
  CD155 v172 IgV
PGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWL

SEQ ID NO: 1652 - protein, 116 aa, Artificial Sequence
  CD155 v173 IgV
PGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWL

SEQ ID NO: 1653 - protein, 116 aa, Artificial Sequence
  CD155 v174 IgV
PGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWL

SEQ ID NO: 1654 - protein, 116 aa, Artificial Sequence
  CD155 v175 IgV
PGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWL

SEQ ID NO: 1655 - protein, 116 aa, Artificial Sequence
  CD155 v176 IgV
PGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWL

SEQ ID NO: 1656 - protein, 116 aa, Artificial Sequence
  CD155 v177 IgV
PGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWL

SEQ ID NO: 1657 - protein, 116 aa, Artificial Sequence
  CD155 v178 IgV
PGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWL

SEQ ID NO: 1658 - protein, 116 aa, Artificial Sequence
  CD155 v179 IgV
PGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWL

SEQ ID NO: 1659 - protein, 116 aa, Artificial Sequence
  CD155 v180 IgV
PGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWL

SEQ ID NO: 1660 - protein, 116 aa, Artificial Sequence
  CD155 v181 IgV
PGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWL

SEQ ID NO: 1661 - protein, 116 aa, Artificial Sequence
  CD155 v182 IgV
PGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWL

SEQ ID NO: 1662 - protein, 116 aa, Artificial Sequence
  CD155 v183 IgV
PGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWL

SEQ ID NO: 1663 - protein, 116 aa, Artificial Sequence
  CD155 v184 IgV
PGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWL

SEQ ID NO: 1664 - protein, 116 aa, Artificial Sequence
  CD155 v185 IgV
PGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWL

SEQ ID NO: 1665 - protein, 116 aa, Artificial Sequence
  CD155 v186 IgV
PGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWL

SEQ ID NO: 1666 - protein, 116 aa, Artificial Sequence
  CD155 v187 IgV
PGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWL

SEQ ID NO: 1667 - protein, 116 aa, Artificial Sequence
  CD155 v188 IgV
PGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWL

SEQ ID NO: 1668 - protein, 116 aa, Artificial Sequence
  CD155 v189 IgV
PGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWL

SEQ ID NO: 1669 - protein, 122 aa, Artificial Sequence
  CD155 v144 IgV
WPPPGTGDVVVQAPTQVTDFLGDSVTLPCYLQVPNTEVTHVSQLTWARHGESGNMAVFHQTQGPSYSESKRLEFVAARPGAEQRNASLRMSGLRVEDEGNYTCLFVMYPQGSRSVDIWLRVL

SEQ ID NO: 1670 - protein, 122 aa, Artificial Sequence
  CD155 v145 IgV
WPPPGTGDLVVQAPTQVLGFLGDSVTLPCYLQVPNMEVTHVSQLTWARHGESGSVAVFHQTQGPSYSELKRLEFVAARPGEELRNASLRMSGLRVEDEGNYTCLFVMFPQGSRSVDIWLRVL

SEQ ID NO: 1671 - protein, 122 aa, Artificial Sequence
  CD155 v146 IgV
WPPPGTGDVVVQAPTQVFGFLGDSVTLPCYLQVPNMEVTQVSQLTWARHGESGSMAVFHQKKGPSYSESKRLEFVAARPGAELRNASLRMSGLRVEDEGNYTCMFVVFPQGSRSVDIWLRVL

SEQ ID NO: 1672 - protein, 122 aa, Artificial Sequence
  CD155 v147 IgV
WPPPGTGDVVVQAPTQVSGFLGDSVTLPCYLRVPNMEVTHVSQLTWARHGESGSMAVFHQTKGPSYSESKRLEFVAAGPGAELRNASLRMSGLRVEDEGNYTCLFVAFPQGSWSVDIWLRVL

SEQ ID NO: 1673 - protein, 122 aa, Artificial Sequence
  CD155 v148 IgV
WPPPGTGDVVVHAPTQVTGFSSDSVTLPCYLQVPNMEVTHVSQLTWARHGESGSMAAFHQTRGPSYSESKRLEFVAARPGAELRNASLRMSGLRVEDEGNYTCLFVMFPQGSRSVDIWLRVL

SEQ ID NO: 1674 - protein, 122 aa, Artificial Sequence
  CD155 v149 IgV
WPPPGTGDIVVQAPTQVSGFLGDPVTLPCYLQVPNMEVTHVSQLTWARQGESGSMAVYHRTKGPSYSESKRLEFVAARPGAELRNASLRMSGLRVEDEGNYTCLFVMFPQGSRSVDIWLRVL

SEQ ID NO: 1675 - protein, 122 aa, Artificial Sequence
  CD155 v150 IgV
WPPPGTGDVVVQAPTQVTGFLGDSVTLPCYLQVPNMEVTHVSQLTCARRGESGSMAVFHQTQGPAYVESKRLEFVTARPGAELRNATLRMFGLRVEDEGNYTCMFVTFPQGSRSVDIWLRVL

SEQ ID NO: 1676 - protein, 122 aa, Artificial Sequence
  CD155 v151 IgV
WPPPGTGDVVVQAPTQVSGFLGDSVTLPCYLQVPNMEVTHVTQLTWARHGGSGSMAVFHQTQGPSYSESKRLEFVAARPGAELRNASLRMSWLRVEDEGNYTCLFVMFPQGSRSVDIWLRVL

SEQ ID NO: 1677 - protein, 122 aa, Artificial Sequence
  CD155 v152 IgV
WPPPGTGDVFVQAPSQVLGFLGDSVTLPCYLQVPNMEVTHVSQLTWAQHGESGSMAVFHQTQGPSYSESKRLEFVAARPGAELRNASLRMSGLRVEDEGNYTCLFVMFPQGSRSMDIWLRVL

SEQ ID NO: 1678 - protein, 122 aa, Artificial Sequence
  CD155 v153 IgV
WPPPGTGDVVVQAPTQVSGFMGDSVTLPCFLQVPDMEVTHVSQLTWARHGESGSMAVFHQTQGPSYSESKRLEFVAARLGAELWNASLRMSGLRVEDEGNYTCLFVMFPQGSRSVGIWLRVL

SEQ ID NO: 1679 - protein, 122 aa, Artificial Sequence
  CD155 v154 IgV
WPPPGTGDVVVQAPTQVFGFLGDSVTLPCYLQVPNMEVTHVSQLTWARHGVSGGMAVFHRTQGPSYSESKRLEFVAARQGAGLRNATLRISRLRVEDEGNYTCLFVMFPQGSRSVDIWLRVL

SEQ ID NO: 1680 - protein, 122 aa, Artificial Sequence
  CD155 v155 IgV
WPPPGTGDVVVQAPTHVFGFLGDSVTLPCYLQVPNMEVTHVSQLTWARHGESGSMAVFHQTQGPSYSESKRLEFVAARLGAELRNASLRMSGLRVEDEGNYTCLFVMFPQGSRSVDIWLRVL

SEQ ID NO: 1681 - protein, 122 aa, Artificial Sequence
  CD155 v156 IgV
WPPPGTGDVVVQAPTQVTGFLGGSVTLPCYLQVPNMEVTHVSQLTWARHGESGSMAVFHRTQGPSYLESKRLEFVAARPGAELRNASLRMSGLRVEDEGNYTCLFVMFPQGSRSADIWLRVL

SEQ ID NO: 1682 - protein, 122 aa, Artificial Sequence
  CD155 v157 IgV
WPPPGTGGIVAQAPTQVTGFLGDSVMLPCYLQVPNMEVTHVSQLTWARHGEPGSMAVFHQTQGPSYSESKRLEFVAARPGAELRNASLRMSALRVEDEGNYTCLFVLFPQGSRSADIWLRVL

SEQ ID NO: 1683 - protein, 122 aa, Artificial Sequence
  CD155 v158 IgV
WPPPGTGDIVVQAPTQVFGFLGDSVTLPCYLQVPNMEVTHVSQLTWERHSESGSMAVFHQTQGPSYSGSKRLEFVAARPGAELRNASLRMSGLRVEDEGNYTCLFVMFPQGSRSVDIWLRVL

SEQ ID NO: 1684 - protein, 122 aa, Artificial Sequence
  CD155 v159 IgV
WPPPGTGDVVVQAPTQVSGFLGDSVTLPCYLQVPNMEVTHVSQLTWARHGESGSIAVFHQTKGPSYSEPKRLEFVAARPGAELRNASLRMSGLRVEDEGNYTCLFVMFPQGSRSVDIWLRVL

SEQ ID NO: 1685 - protein, 122 aa, Artificial Sequence
  CD155 v160 IgV
WPPPGTGDVVVQAPTQVTGFLGDSVTLPCYLQVPNMEVSHVSQLTWARHGEPGRMAVFHQTQGPSYSESKRLEFVAARPGAELRNASLRMSGLRVEDEGNYTCLFVMFPQGSRSVDIWLRVL

SEQ ID NO: 1686 - protein, 122 aa, Artificial Sequence
  CD155 v161 IgV
WPPPGTGDVVVQAPTQVSGFLGNSVTLPCYLQVPNMEVTHVSQLTWARHGESGSMAVFHQTQGPSYSESKRLEFVAARPGAELRNASLRMSGLRVEDEGNYTCLFVMFPQGSRNVDIWLRVL

SEQ ID NO: 1687 - protein, 122 aa, Artificial Sequence
  CD155 v162 IgV
WPPPGTGDVVVQAPTQVSGFLGDSVTLPCYLQVSNMEVTHVSQLTWARHGVSGSMAVFHQTQGPSYSESKRLEFVAARPGAELRNASLRMSGLRVEDEGNYTCLFVTFPQRSRSVDIWLRVL

SEQ ID NO: 1688 - protein, 122 aa, Artificial Sequence
  CD155 v163 IgV
WPPPGTGDVVVQAPTQVSGFLGDSVTLPCYLQVPNMEVTHVSQLTWARHGESGSMAVFNQTQGPSYSESKRLEFAAARPGTELRNASLRMSGLRVEDEGNYTCMFVMFPQGSRSVDIWLRVL

SEQ ID NO: 1689 - protein, 122 aa, Artificial Sequence
  CD155 v164 IgV
WPPPGTGDVVVQAPTQVSGFLGDSVTLPCYLQVPNMEVTHVSQLTRARHGESGSMAVFHQTQGPSYSDSKRLEFVAARPGAELRNASLRMSGLRVEDEGNYTCLFVMFPQGSGSVDIWLRVL

SEQ ID NO: 1690 - protein, 122 aa, Artificial Sequence
  CD155 v165 IgV
WPPPGTGDLVVQAPTQVFGFLGDSVTLPCYLQVPNMEVTHVSQLAWARHGESGSMAVFHQTQGPAYVESKRLEFVAAKVGAELRNASLRMSGLRVEDEGNYTCLFVMFPQGSRTVDIWLRVL

SEQ ID NO: 1691 - protein, 122 aa, Artificial Sequence
  CD155 v166 IgV
WPPPGTGDVVVQAPTQVTGFLGDSVTLPCYLQVPNMEVTHVSQLTWARHGESGSLAVFHQRQGPSYSESKRLEFVAARPGAELRNASLRMSGLRVEDEGNYTCLFIMFPQGSRSVDIWLRVL

SEQ ID NO: 1692 - protein, 122 aa, Artificial Sequence
  CD155 v167 IgV
WPPPGTGDVVVQAPIQVSGFLGDSVTLPCYLQMPFMEVSHVSQLTWARHGESGSLAVFHQTQGPSYSESKRLEFVAASPGAELRNASLRMSGLRVEDEGNYTCLFVMFPQGSRSVDIWLRVL

SEQ ID NO: 1693 - protein, 122 aa, Artificial Sequence
  CD155 v168 IgV
WPPPGTGDVVVQAPTQVSGFLGDSVTLPCYLQVPNMEVTHVSQLTWARHGESGSMAVFHQTKGPSYSESERLEFVAARPGAELRNASLRMSELRVEDEGNYTCLFVTFPQGSWSVDIWLRVL

SEQ ID NO: 1694 - protein, 122 aa, Artificial Sequence
  CD155 v169 IgV
WPPPGTGDVVVQAPTQVFGILGDSVMLPCYLQVPNMEVTHVSQLTWVRHGKSGSMAVFHQTQGPSYSESKRLEFVAARPGAELRNASLRMSGLRVEDEGNYTCLFVTFPQGSRSVDIWLRVL

SEQ ID NO: 1695 - protein, 122 aa, Artificial Sequence
  CD155 v170 IgV
WPPPGTGDVVVQAPTQVTGFLGASVTLPCYLQVPNMEVTHVSQLTWARHGESGSMAVFHHTQGPSYSESKRLEFVAARPGAELRNASLRVSGLRVEDEGNYTCLFVMFPQGSRSVDIWLRVL

SEQ ID NO: 1696 - protein, 122 aa, Artificial Sequence
  CD155 v171 IgV
WPPPGTGDVVVQAPTQVSGFLGGSVTLPRYLQVPDMGVTHVSQLTWARHGESGSIAVFHQTKGPAYGESKRLEFVAAGPGAELRNASLRMSGLRVEDEGNYTCMFVMFPRGSRSVDIWLRVL

SEQ ID NO: 1697 - protein, 122 aa, Artificial Sequence
  CD155 v172 IgV
WPPPGTGDVVVQEPTQVSGFLGDSVTLPCYLQVPNREVTHVSQLTWARHGESGSMAVFHQTKGPSYTESKRLEFVAARPGAELRDASLRMSGLRVEDEGNYTCLFVMFPQGSRSVDIWLRVL

SEQ ID NO: 1698 - protein, 122 aa, Artificial Sequence
  CD155 v173 IgV
WPPPGTGDIVVQAPTQVTGFLGDSVTLPCYLQVPNMEVTHVSQLTWARRGESGSMAVFHQTQGPSYSESKRLEFVAARPGAELRDASLRMSGLRVEDEGNYTCTFVMFPQGSRSVDIWLRVL

SEQ ID NO: 1699 - protein, 122 aa, Artificial Sequence
  CD155 v174 IgV
WPPPGTGDAVVQAPTQVFGFLGDSVTLPCYLQVPNMEVTHVSQLTWARHGESGSMAVFHQSLGPSYSESKRLEFVAARPGAELRNASLRMSGLRVEDEGNYTCLFVTFPQRSRSVDIWLRVL

SEQ ID NO: 1700 - protein, 122 aa, Artificial Sequence
  CD155 v175 IgV
WPPPGTGEVVVQAPTQVTGFLGDSVTLPCYLQVPNMEVTHVSQLTWARHGESGSMAVFHQAQGPSYSESKRLEFVAARPGAELRNASLRMSGLRVEDEGNYTCLFVMFPQGSRSVDIWLRVL

SEQ ID NO: 1701 - protein, 122 aa, Artificial Sequence
  CD155 v176 IgV
WPPPGTGDVVVQAPTQVSGFLGDSVTLPCYLQVPNMEVTHASQLTWARRGESGCMAVFHQTQGPSYSESKRLEFVAARSGAELRYASPRMSGLRVEDEGNYTCMFVMFPQGSRSVDIWLRVL

SEQ ID NO: 1702 - protein, 122 aa, Artificial Sequence
  CD155 v177 IgV
WPPPGTGDVVEQAPTQVHGYLGDSETLPCYLQVPSMEVTHVSQLTWARRGESGSMAVFHQTQGPSYSESKRLEFVAARPGAELRNASLRMSGLRVEDEGNYTCLFVMFPQRSRSVDIWLRVL

SEQ ID NO: 1703 - protein, 122 aa, Artificial Sequence
  CD155 v178 IgV
WPPPGTGDVVAQAPTQVFGFLGASVTLPCYLQVPNMEVTHVSQLTWARHGESGSMAVFHQTQGPSYSESKRLEFVAARPDAELRNASLRMFGLRAEDEGNYTCLFVMFPQGSRSVDIWLRVL

SEQ ID NO: 1704 - protein, 122 aa, Artificial Sequence
  CD155 v179 IgV
WPPPGTGDVVVQAPTQVSGFLGDSVTLPCYLQVPNMEVTHVSQLTWARHGESGSMAVFHQTQGPSYSESRRLEFVAARPGAELRNASLRMSGLRVEDEGNYTCLFVTFPQRSRSVDIWLRVL

SEQ ID NO: 1705 - protein, 122 aa, Artificial Sequence
  CD155 v180 IgV
WPPPGTGDLVMQAPTQVSGFLGDSVTLPCYLQVPSMEVTHVSQLTWARHGESGGMAVFHQTKGPSYSESKRLEFVAARPGAELRNASLRMFGLRVEDEGNYTCMFVMFPQGSRSMDIWLRVL

SEQ ID NO: 1706 - protein, 122 aa, Artificial Sequence
  CD155 v181 IgV
WPPPGTGDLVVQAPTQVYGFLGDSATLPCYLQVPNMEGTHVSQLTWARHGESGSVAVFHQTQGPSYSESKRLEFVATRPGAELRNASLRISGLRVEDEGNYTCMFVTFPQGSRSVDIWLRVL

SEQ ID NO: 1707 - protein, 122 aa, Artificial Sequence
  CD155 v182 IgV
WPPPGTGDVGVQAPTQVTGFLGDSVTLPCYLQVPNMEVTHVSQLTWARHGESGSMAVFHQTQGPSYSESKRQEFVAARPGAELRNASLRMSGLRVEDEGNYTCLFVMFPQGSRSVDIWLRVL

SEQ ID NO: 1708 - protein, 122 aa, Artificial Sequence
  CD155 v183 IgV
WPPPGTGDVVVQAPTQVSGFLGDSVTLPCYLQVPNMEVTHVSQLTWARHGESGSMAVFRQTQGPSYSESKRLEFVGASPGAELRNASLRMFGLRVEDEGNYTCLFVTFPQGSRSVDIWLRVL

SEQ ID NO: 1709 - protein, 122 aa, Artificial Sequence
  CD155 v184 IgV
WPPPGTGDAVVQAPTQVSGFLGDSVTLPCYLQVPNTEVTHVSQLTWARHGESGSMAVFHQTQGPGYSESKRLEFVAARPGAELRNASLRMSGLRVEDEGNYTCTFVTFPQRIRSVDIWLRVL

SEQ ID NO: 1710 - protein, 122 aa, Artificial Sequence
  CD155 v185 IgV
WPPPGTGDVVVQAPTQVTGFLGDSVTLPCYLQVPNMEVTHVSQLTWARHGEAGSMAAFHRTKGPCYSESKRLEFVAARPGAELRNASLRMTGLRVEDEGYYTCLFVMFPQGSRSVDIWLRVL

SEQ ID NO: 1711 - protein, 122 aa, Artificial Sequence
  CD155 v186 IgV
WPPPGTGDVVAQAPTQVFGFLGDSVTLPCYLQVPDMEVTHVSQLTWERHGESGSMAVFHQTKGPSYSESKRLEFVAARPGAELRNASLRMSGLRVEDEDNYTCLFVMFPQGSRNVDIWLRVL

SEQ ID NO: 1712 - protein, 122 aa, Artificial Sequence
  CD155 v187 IgV
WPPPGTGDVVAQAPTQVTGFLGDSVTLPCYLQVPSMEVTHVSQLTWARHGESGSMAVFHQTQGPSYSESKRLEFVAARPGAELRNATLRMSGLRVEDEGNYTCLFVTFPQGSRSVDIWLRVL

SEQ ID NO: 1713 - protein, 122 aa, Artificial Sequence
  CD155 v188 IgV
WPPPGTGDDVMLAPTQVSGFLGDSVTLPCYLQVPNMVVTHVSQLTWARHGESGSIAVFHRTQGPSYSESQRLEFVAARPGAELRNASLRMSGLRVEDEGNYTCMFVMFPQGSRSVDIWLRVL

SEQ ID NO: 1714 - protein, 122 aa, Artificial Sequence
  CD155 v189 IgV
WPPPGTGDVVVQAPSQVSGFLGDSVTLPCHLLVPNMEVTHVSQLTWARHGESGSMAVFHQTRGPSYSESKRLEFVAARPGAELRNASLRMSGLRVEDEGNYTCLFVMFPQGSRSVDIWLRVL

SEQ ID NO: 1715 - protein, 231 aa, Artificial Sequence
  Stack Fc Lysine removed (homodimeric)
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1716 - protein, 494 aa, Artificial Sequence
  PD-L1/CD155 Stack 1 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 1717 - protein, 494 aa, Artificial Sequence
  PD-L1/CD155 Stack 2 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1718 - protein, 494 aa, Artificial Sequence
  PD-L1/CD155 Stack 3 Fc fusion
WPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1719 - protein, 494 aa, Artificial Sequence
  PD-L1/CD155 Stack 4 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1720 - protein, 507 aa, Artificial Sequence
  PD-L1/CD155 Stack 5 Fc fusion
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 1721 - protein, 507 aa, Artificial Sequence
  PD-L1/CD155 Stack 6 Fc fusion
HMSSVSAQEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVL

SEQ ID NO: 1722 - protein, 635 aa, Artificial Sequence
  PD-L1/CD112/CD155 Stack 1 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRV

SEQ ID NO: 1723 - protein, 635 aa, Artificial Sequence
  PD-L1/CD112/CD155 Stack 2 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1724 - protein, 636 aa, Artificial Sequence
  PD-L1/CD112/CD155 Stack 3 Fc fusion
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGFVRGMTWLRVGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRMFGLRVEDEGNYTCQFVTFPQRSRSVDIWLRVLGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1725 - protein, 221 aa, Artificial Sequence
  PD-L1 ECD v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1726 - protein, 108 aa, Artificial Sequence
  PD-L1 IgV 66
PKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKV

SEQ ID NO: 1727 - protein, 115 aa, Artificial Sequence
  PD-L1 IgV v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNA

SEQ ID NO: 1728 - protein, 221 aa, Homo sapiens [sequence omitted]

SEQ ID NO: 1729 - protein, 221 aa, Artificial Sequence
  PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1730 - protein, 221 aa, Artificial Sequence
  PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNERT

SEQ ID NO: 1731 - protein, 221 aa, Artificial Sequence
  PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNERT

SEQ ID NO: 1732 - protein, 221 aa, Artificial Sequence
  PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNERT

SEQ ID NO: 1733 - protein, 221 aa, Artificial Sequence
  PD-L1 ECD v71
FTVTVPKDLYVVEYGSNMTIERKFPVEKQLDLAALIVYWEMEDKNIIQFVHGEEDLKVQHSSYRLRARLLKDQLSLGNAALQITDVKLQDAGVYRCMISYGGADYKRITVKVNAPYNKINQRISVVDPVTSEHELTCQAEGYPQAEVIWTSSDHQVLSGKTTTTNSKREEKLFNVTSTLRINTTTNEIFYCTFRGLDPENNQTAELVIPELPLAHPPNERL

SEQ ID NO: 1734 - protein, 221 aa, Artificial Sequence
  PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNERT

SEQ ID NO: 1735 - protein, 221 aa, Artificial Sequence
  PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNERT

SEQ ID NO: 1736 - protein, 221 aa, Artificial Sequence
  PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNERT

SEQ ID NO: 1737 - protein, 221 aa, Artificial Sequence
  PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1738 - protein, 221 aa, Artificial Sequence
  PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1739 - protein, 221 aa, Artificial Sequence
  PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNERT

SEQ ID NO: 1740 - protein, 221 aa, Artificial Sequence
  PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNERT

SEQ ID NO: 1741 - protein, 221 aa, Artificial Sequence
  PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1742 - protein, 221 aa, Artificial Sequence
  PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1743 - protein, 221 aa, Artificial Sequence
  PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1744 - protein, 221 aa, Artificial Sequence
  PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1745 - protein, 221 aa, Artificial Sequence
  PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1746 - protein, 221 aa, Artificial Sequence
  PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1747 - protein, 221 aa, Artificial Sequence
  PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1748 - protein, 221 aa, Artificial Sequence
  PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1749 - protein, 221 aa, Artificial Sequence
  PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1750 - protein, 221 aa, Artificial Sequence
  PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNERT

SEQ ID NO: 1751 - protein, 221 aa, Artificial Sequence
  PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNERT

SEQ ID NO: 1752 - protein, 221 aa, Artificial Sequence
  PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNERT

SEQ ID NO: 1753 - protein, 221 aa, Artificial Sequence
  PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNERT

SEQ ID NO: 1754 - protein, 221 aa, Artificial Sequence
  PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNERT

SEQ ID NO: 1755 - protein, 221 aa, Artificial Sequence
  PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1756 - protein, 221 aa, Artificial Sequence
  PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1757 - protein, 221 aa, Artificial Sequence
  PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNERT

SEQ ID NO: 1758 - protein, 221 aa, Artificial Sequence
  PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNERT

SEQ ID NO: 1759 - protein, 221 aa, Artificial Sequence
  PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1760 - protein, 221 aa, Artificial Sequence
  PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1761 - protein, 221 aa, Artificial Sequence
  PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNERT

SEQ ID NO: 1762 - protein, 221 aa, Artificial Sequence
  PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1763 - protein, 221 aa, Artificial Sequence
  PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNERT

SEQ ID NO: 1764 - protein, 221 aa, Artificial Sequence
  PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1765 - protein, 221 aa, Artificial Sequence
  PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1766 - protein, 221 aa, Artificial Sequence
  PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNERT

SEQ ID NO: 1767 - protein, 221 aa, Artificial Sequence
  PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNERT

SEQ ID NO: 1768 - protein, 221 aa, Artificial Sequence
  PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1769 - protein, 221 aa, Artificial Sequence
  PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNERT

SEQ ID NO: 1770 - protein, 221 aa, Artificial Sequence
  PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1771 - protein, 221 aa, Artificial Sequence
  PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNERT

SEQ ID NO: 1772 - protein, 221 aa, Artificial Sequence
  PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1773 - protein, 221 aa, Artificial Sequence
  PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNERT

SEQ ID NO: 1774 - protein, 221 aa, Artificial Sequence
  PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1775 - protein, 221 aa, Artificial Sequence
  PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1776 - protein, 221 aa, Artificial Sequence
  PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1777 - protein, 221 aa, Artificial Sequence
  PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1778 - protein, 221 aa, Artificial Sequence
  PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1779 - protein, 221 aa, Artificial Sequence
  PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1780 - protein, 221 aa, Artificial Sequence
  PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1781 - protein, 221 aa, Artificial Sequence
  PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1782 - protein, 221 aa, Artificial Sequence
  PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNERT

SEQ ID NO: 1783 - protein, 221 aa, Artificial Sequence
  PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNERT

SEQ ID NO: 1784 - protein, 221 aa, Artificial Sequence
  PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNERT

SEQ ID NO: 1785 - protein, 221 aa, Artificial Sequence
  PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNERT

SEQ ID NO: 1786 - protein, 221 aa, Artificial Sequence
  PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1787 - protein, 221 aa, Artificial Sequence
  PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1788 - protein, 221 aa, Artificial Sequence
  PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNERT

SEQ ID NO: 1789 - protein, 221 aa, Artificial Sequence
  PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1790 - protein, 221 aa, Artificial Sequence
  PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1791 - protein, 221 aa, Artificial Sequence
  PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1792 - protein, 221 aa, Artificial Sequence
  PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNERT

SEQ ID NO: 1793 - protein, 221 aa, Artificial Sequence
  PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1794 - protein, 221 aa, Artificial Sequence
  PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNERT

SEQ ID NO: 1795 - protein, 221 aa, Artificial Sequence
  PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1796 - protein, 221 aa, Artificial Sequence
  PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNERT

SEQ ID NO: 1797 - protein, 221 aa, Artificial Sequence
  PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNERT

SEQ ID NO: 1798 - protein, 221 aa, Artificial Sequence
  PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1799 - protein, 221 aa, Artificial Sequence
  PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNERT

SEQ ID NO: 1800 - protein, 221 aa, Artificial Sequence
  PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNERT

SEQ ID NO: 1801 - protein, 221 aa, Artificial Sequence
  PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNERT

SEQ ID NO: 1802 - protein, 221 aa, Artificial Sequence
  PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNERT

SEQ ID NO: 1803 - protein, 221 aa, Artificial Sequence
  PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNERT

SEQ ID NO: 1804 - protein, 221 aa, Artificial Sequence
  PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNERT

SEQ ID NO: 1805 - protein, 221 aa, Artificial Sequence
  PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNERT

SEQ ID NO: 1806 - protein, 221 aa, Artificial Sequence
  PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNERT

SEQ ID NO: 1807 - protein, 221 aa, Artificial Sequence
  PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNERT

SEQ ID NO: 1808 - protein, 221 aa, Artificial Sequence
  PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNERT

SEQ ID NO: 1809 - protein, 221 aa, Artificial Sequence
  PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNERT

SEQ ID NO: 1810 - protein, 221 aa, Artificial Sequence
  PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNERT

SEQ ID NO: 1811 - protein, 221 aa, Artificial Sequence
  PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNERT

SEQ ID NO: 1812 - protein, 221 aa, Artificial Sequence
  PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNERT

SEQ ID NO: 1813 - protein, 221 aa, Artificial Sequence
  PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNERT

SEQ ID NO: 1814 - protein, 221 aa, Artificial Sequence
  PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1815 - protein, 221 aa, Artificial Sequence
  PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNERT

SEQ ID NO: 1816 - protein, 221 aa, Artificial Sequence
  PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNERT

SEQ ID NO: 1817 - protein, 221 aa, Artificial Sequence
  PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNERT

SEQ ID NO: 1818 - protein, 221 aa, Artificial Sequence
  PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNERT

SEQ ID NO: 1819 - protein, 220 aa, Artificial Sequence
  PD-L1 ECD v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1820 - protein, 220 aa, Artificial Sequence
  PD-L1 ECD v68
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEILYCTFRRLDPEENHTAELVIPELPLAHPPNER

SEQ ID NO: 1821 - protein, 220 aa, Artificial Sequence
  PD-L1 ECD v69
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTSRGLDPEKNQTAELVIPELPLAHPPNER

SEQ ID NO: 1822 - protein, 220 aa, Artificial Sequence
  PD-L1 ECD v70
FTVTVPKDLYVVEYGSNMTIECKFPVEKQLDLAALSVYWEKEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPQAEVIWTSSDHQVLSGKTTTTNSKREEKLFNVTSTLRINTTTNEIFYCTFRGLDPEKNQTAEFVIPELPLAHPPNER

SEQ ID NO: 1823 - protein, 220 aa, Artificial Sequence
  PD-L1 ECD v72
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCMLSYGGADYKRITVKVNAPYNKINQRISVVDPVTSEHELTCQAEGYPKAEVIWTSSDHQVLSGKTTTTNSKREEKLFNVTSTLRINTTTNEIFYCTFRRLDTEENHTAEFVIPELPLAHPPNER

SEQ ID NO: 1824 - protein, 220 aa, Artificial Sequence
  PD-L1 ECD v73
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYSKINQRILVVDPVTSEHELTCQAEGYPKAEVVWTSSDHQVLSGKTTTTNSKREERLFNVTSTLSINTTTNEIFYCTFRRLDPEENHTAELVIPELPLAHPPNER

SEQ ID NO: 1825 - protein, 220 aa, Artificial Sequence
  PD-L1 ECD v74
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGVDYKRITVKVNAPYNKINQRILVVDPVTSEHELTCQAEGYPKAEVIWTSSDHHVLSGKTTTTNSKREEKLFNVTSTLRINTTTNEIFYCTFRRLDPEENHTAELVIPELPLAHPPNER

SEQ ID NO: 1826 - protein, 220 aa, Artificial Sequence
  PD-L1 ECD v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1827 - protein, 220 aa, Artificial Sequence
  PD-L1 ECD v76
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1828 - protein, 220 aa, Artificial Sequence
  PD-L1 ECD v77
FTVTVPKDLYVVEYGSNMTIECKFPVEKQLDLAALIVYWEMEDKNIIQFVHGEEDLKVQHSSYRQRARLLKDQLSLGNTALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDPEKNQTAEFVIPELPLAHPPNER

SEQ ID NO: 1829 - protein, 220 aa, Artificial Sequence
  PD-L1 ECD v78
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRISVVDPVTSEHELTCQAEGYPQAEVIWTSSDHQVLSGKTTTTNSKREEKLFNVTSTLRINTTTNEIFYCTFRRLDPEENHTAELVIPELPLAHPPNER

SEQ ID NO: 1830 - protein, 220 aa, Artificial Sequence
  PD-L1 ECD v79
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1831 - protein, 220 aa, Artificial Sequence
  PD-L1 ECD v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1832 - protein, 220 aa, Artificial Sequence
  PD-L1 ECD v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1833 - protein, 220 aa, Artificial Sequence
  PD-L1 ECD v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1834 - protein, 220 aa, Artificial Sequence
  PD-L1 ECD v83
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1835 - protein, 220 aa, Artificial Sequence
  PD-L1 ECD v84
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1836 - protein, 220 aa, Artificial Sequence
  PD-L1 ECD v85
FTVTVPKDLYVVEYASNMTIECKFPVEKQLDLAALTVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1837 - protein, 220 aa, Artificial Sequence
  PD-L1 ECD v86
FTVTVPKDLYVVEYASNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1838 - protein, 220 aa, Artificial Sequence
  PD-L1 ECD v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1839 - protein, 220 aa, Artificial Sequence
  PD-L1 ECD v88
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTTELVIPELPLAHPPNER

SEQ ID NO: 1840 - protein, 220 aa, Artificial Sequence
  PD-L1 ECD v89
FTVTVPKDLYVVEYGSNMTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPATSEHELTCQAEGYPKAEVIWTSSDHQVLSGKTTTTNSKREEKLLNVTSTLRINTTTNEIFYCTFRRLDPEENHTAELVIPELPLAHPPNER

SEQ ID NO: 1841 - protein, 220 aa, Artificial Sequence
  PD-L1 ECD v90
FTVTVPKDLYVVEYGSNMTIECKFPVEKQLDLAALTVYWEMEDKNIIQFVHGEESLKVQHSSYRQRARLLKDQLSLGNAALQITDVKLQDAGVYRCLISYGGADYKRITVEVNAPYNKINQRILVVDPVTSEHELTCQAEGYPKAEVVWTSSDHQVLSGKTTTTNSKREEKLFNVTSTLSINTTTNEIFYCTFRRLDPEENHTAELVIPELPLAHPPNER

SEQ ID NO: 1842 - protein, 220 aa, Artificial Sequence
  PD-L1 ECD v91
FTVTVPKDLYVVEYGSNMTIECKFPVEKQLDLAALTVYWEMEDKNIIQFVHREEDLKVQHSSYRQRARLLKDQLSLGNAALQITDVKLQDAGVYRCLISYGGADYKRITVKANAPYNKINQRILVVDPVTSEHELTCQAEGYPEAEVIWTSSDHQVLSGKTTTTNSKREEKLFNATSTLRINTTTNEIFYCTFRRLDTEENHTAELVIPELPLAHPPNER

SEQ ID NO: 1843 - protein, 220 aa, Artificial Sequence
  PD-L1 ECD v92
FTVTVPKDLYVVEYGSNMTIECKFPVEKQLDLAALTVYWEMEDKNVIQFVHGEEGLKVQHSSYRQRARLLKDQLSLGNAALQITDVKLQDAGVYRCLISYGGADYERITVKVNAPYNKINQRILVVDPVTSEHELTCQAEGYPEAEVIWTSSDHQVLSGKTTTTNSKREEKLFNVTSTLRINTTANEIFYCTFRGLDPEENHTAELVIPELPLAHPPNER

SEQ ID NO: 1844 - protein, 220 aa, Artificial Sequence
  PD-L1 ECD v93
FTVTVPKDLYVVEYGSNMTIECKFPVEKQLDLAALTVYWEMEDKNIIQFVHGEEDLKVQHSSYRQRARLLKDQLSLGNAALQTTDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1845 - protein, 220 aa, Artificial Sequence
  PD-L1 ECD v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1846 - protein, 220 aa, Artificial Sequence
  PD-L1 ECD v95
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDTEENHTAELVIPELPLAHPPNER

SEQ ID NO: 1847 - protein, 220 aa, Artificial Sequence
  PD-L1 ECD v96
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHHVLSGKTTTTNSKREEKLFNVTSTLRINTTTNEIFYCTSRRLDPEEYHTAELVIPELPLAHPPNER

SEQ ID NO: 1848 - protein, 220 aa, Artificial Sequence
  PD-L1 ECD v97
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1849 - protein, 220 aa, Artificial Sequence
  PD-L1 ECD v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1850 - protein, 220 aa, Artificial Sequence
  PD-L1 ECD v99
FTVTVPKDLYVVEYGSNITIECKFPVEKQLDLAALTVYWEMEDKNIIQFVHGGEDLKVQHSSYRQRARLLKDQLSLGNAALQITDVKLQDAGVYRCLISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPGENHTAELAIPELPLAHPPNER

SEQ ID NO: 1851 - protein, 220 aa, Artificial Sequence
  PD-L1 ECD v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1852 - protein, 220 aa, Artificial Sequence
  PD-L1 ECD v101
FTVTVPKDLYVVEYGSNVTIECKFPVEKQLDLAALIVYWEMEDKNIIQFVHGEEDLKVQHSSYRQRARLLKDQLSLGNAALQITDVKLQDAGVYRCLISYGGADYKRITVKVNAPYNKINQRILVVDPVTSEHELTCQAEGYPKAEVIWTSSDHQVLSGKTTTTNSKREEKLFNVNSTLRINTTTNEIFYCTFRGLDPEENHTAELVIPELPLAHPPNER

SEQ ID NO: 1853 - protein, 220 aa, Artificial Sequence
  PD-L1 ECD v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1854 - protein, 220 aa, Artificial Sequence
  PD-L1 ECD v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1855 - protein, 220 aa, Artificial Sequence
  PD-L1 ECD v104
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTANEIFYCTFRGLDTEENHTAELVIPELPLAHPPNER

SEQ ID NO: 1856 - protein, 220 aa, Artificial Sequence
  PD-L1 ECD v105
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENQTAELVIPELPLAHPPNER

SEQ ID NO: 1857 - protein, 220 aa, Artificial Sequence
  PD-L1 ECD v106
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1858 - protein, 220 aa, Artificial Sequence
  PD-L1 ECD v107
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWASSDHQVLSGKTTTTNSKREEKLFNVTSTLRINTTTNEIFYCTFRRLDPEENHTAELVIPELPLAHPPNER

SEQ ID NO: 1859 - protein, 220 aa, Artificial Sequence
  PD-L1 ECD v108
FTVTVPKDLYVVEYGSNMTIECKFPVEKQLDLAALIVYWEMEDKNIIQFVHGEEDLKVQHSSYRQRARLLKDQLSLGNAALQITDVKLQDAGEYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1860 - protein, 220 aa, Artificial Sequence
  PD-L1 ECD v109
FTVTVPKDLFVVEYGSNVTIECKFPVEKQLDLAALIVYWEMEDKNIIQFVHGEEDLKVQHSSYRQRARLLKDQLSLGNAALQITDVKLQDAGVYRCMIGYGGADYKRITVKVNAPYNKINQRILVVDPVTSEHELTCRAEGYPKAEVIWTSSDHQVLSGKTTTTNSKREEKLFNVTSTLRINTTTNEIFYCTFRRLDPEENHAAELVIPELPLAHPPNER

SEQ ID NO: 1861 - protein, 220 aa, Artificial Sequence
  PD-L1 ECD v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1862 - protein, 220 aa, Artificial Sequence
  PD-L1 ECD v111
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGMTTTTNSKREEKLFNVTSTLRINTTTNEIFYCTFRGLDPEENHTAELVIPELPLAHPPNER

SEQ ID NO: 1863 - protein, 220 aa, Artificial Sequence
  PD-L1 ECD v112
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1864 - protein, 220 aa, Artificial Sequence
  PD-L1 ECD v113
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1865 - protein, 220 aa, Artificial Sequence
  PD-L1 ECD v114
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1866 - protein, 220 aa, Artificial Sequence
  PD-L1 ECD v115
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1867 - protein, 220 aa, Artificial Sequence
  PD-L1 ECD v116
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1868 - protein, 220 aa, Artificial Sequence
  PD-L1 ECD v117
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1869 - protein, 220 aa, Artificial Sequence
  PD-L1 ECD v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1870 - protein, 220 aa, Artificial Sequence
  PD-L1 ECD v119
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1871 - protein, 220 aa, Artificial Sequence
  PD-L1 ECD v120
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMTSYGGADYKRITVKVNAPYNKINQRILVVDPVTSEHELTCQAEGYPKAEVIWTSSDHQVLSGKTTTTNSKREEKLYNVTSTLRINTTTNEIFYCTFRRSDPEENHTAELVIPELPLAHPPNER

SEQ ID NO: 1872 - protein, 220 aa, Artificial Sequence
  PD-L1 ECD v121
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHGLTCQAEGYPKAEVIWTSSDHQVLSGKTTTTNSKREEKLFNVTSTLRINTTTNEIFYCTFRRLDPEENHTAELVIPELPPAHPPNER

SEQ ID NO: 1873 - protein, 220 aa, Artificial Sequence
  PD-L1 ECD v122
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLINVTCTLRINTTTNEIFYCTFRRLDPEENHTAELVIPELPLAHPPNER

SEQ ID NO: 1874 - protein, 220 aa, Artificial Sequence
  PD-L1 ECD v123
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEENHTAELVIPELPLAHPPNER

SEQ ID NO: 1875 - protein, 220 aa, Artificial Sequence
  PD-L1 ECD v124
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1876 - protein, 220 aa, Artificial Sequence
  PD-L1 ECD v125
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVYAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1877 - protein, 220 aa, Artificial Sequence
  PD-L1 ECD v126
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTYSKREGKLFNVTSTLRINTTTNEIFYCTFRRLDPEENHTAELVIPELPLAHPPNER

SEQ ID NO: 1878 - protein, 220 aa, Artificial Sequence
  PD-L1 ECD v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1879 - protein, 220 aa, Artificial Sequence
  PD-L1 ECD v128
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTFEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1880 - protein, 220 aa, Artificial Sequence
  PD-L1 ECD v129
FTVTVPKDLYVVEYGSNMTIECKFPVEKQLDLAALIVYWEMEDKDIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1881 - protein, 220 aa, Artificial Sequence
  PD-L1 ECD v131
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRTLDPEENHTAELVIPELPLAHPPNER

SEQ ID NO: 1882 - protein, 220 aa, Artificial Sequence
  PD-L1 ECD v131
FTVTVPKDLYVVEYGSNMTIECKFPVDKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1883 - protein, 220 aa, Artificial Sequence
  PD-L1 ECD v132
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLYNVTSTLRINITTNEIFYCTFRRSDPEENHAAELVIPELPLAHPPNER

SEQ ID NO: 1884 - protein, 220 aa, Artificial Sequence
  PD-L1 ECD v133
FTVTVPKDLYVVEYGSNMTIECNFPVEKQLDLAALIVYWEMEDKDIIQFVHGEEDLKVQHSSYRQRARLLKDQLPLGNAALQITDVKLQDAGVYRCMISYGGADYKRITVKVNAPYNKISQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1885 - protein, 220 aa, Artificial Sequence
  PD-L1 ECD v134
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGDADYKRITVKVNAPYNKINQRILVVDPVTSEHELTCQAEGYPKAEVIWTSSDHQVLSGKTTTTNSKREEKLFNVTSTLRINTTTNEIFYCTFWGLDPEENHTAELVIPELPLAHPPNER

SEQ ID NO: 1886 - protein, 220 aa, Artificial Sequence
  PD-L1 ECD v135
FTVTVPKDLYVVEYGSNMTIECKFPVEKQLDLAALIVYWEMEDKDIIQFVHVEEDLKVQHSSYRQRARLLKDQLSLGNAALQITDVKLQDAGVYRCMISYGGADYKRITVKVNAPYNKINLRILVVDPVTSEHELTCQAEGYPKAEVIWTSSDHQVLSGKTTTTNSKREEKLFNVTSTLRINTTTNEIFYCTFRRLDSEENHTAELVIPELPLAHPPNER

SEQ ID NO: 1887 - protein, 220 aa, Artificial Sequence
  PD-L1 ECD v136
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1888 - protein, 220 aa, Artificial Sequence
  PD-L1 ECD v137
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVTVNAPYNKINQRILVVDPVTSEHELTCQAEGYPKAEVIWTSSDHQVLSGKTTTTNSKREEKLFNVTSTLRINATTNEVFYCTFRRLDPEENHTAELVIPELPLAHPPNER

SEQ ID NO: 1889 - protein, 220 aa, Artificial Sequence
  PD-L1 ECD v138
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEISYCTFRRLDSEENHTAELVIPELPLAHPPNER

SEQ ID NO: 1890 - protein, 220 aa, Artificial Sequence
  PD-L1 ECD v139
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMIGYGGADYKRITVKVNAPYNKINQRILVVDPVTSEHELTRQAEGYPKAEVIWTSSDHQVLSGKTTTTNSKREEKLFNVTSTLRINTTTNEIFYCTFRRLDPEENHTAELAIPELPLAHPPNER

SEQ ID NO: 1891 - protein, 220 aa, Artificial Sequence
  PD-L1 ECD v140
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSRREEKLFNVTSTLRINTTTNEIFYCTFRGLDPEENHTAELVIPELPLAHPPNER

SEQ ID NO: 1892 - protein, 220 aa, Artificial Sequence
  PD-L1 ECD v141
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINATTNEIFYCSFGRLDPEENHTAELVIPELPLAHPPNER

SEQ ID NO: 1893 - protein, 220 aa, Artificial Sequence
  PD-L1 ECD v142
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKTNQRILVVDPVTSEHELTCQAEGYPEAEVIWTSSDHQVLSGKTTTTNSKREEKLFNVTSTLRINTTTNEIFYCTFRRLDPEENHTAELVIPELPLAHPPNER

SEQ ID NO: 1894 - protein, 220 aa, Artificial Sequence
  PD-L1 ECD v143
FTVTVPKDLYVVEYGSNMAIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPEAEVIWTSSDHQVLSGKTTTTNSKREEKLFNVTSTLRINTTTNEIFYCTFRGLDPEENHTAELVIPELPLAHPPNER

SEQ ID NO: 1895 - protein, 220 aa, Artificial Sequence
  PD-L1 ECD v144
FTVTVPKDLYEVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVASEHELTCQAEGYPKAEVIWTSSDHQVLSGKTTTTNSKREEKLFNVTSTLRINTTTNEIFYCTFRRLDTEENHTAELVIPELPLAHPPNER

SEQ ID NO: 1896 - protein, 220 aa, Artificial Sequence
  PD-L1 ECD v145
FTVTVPKDLYVVEYGSNMTIECKFPAEKQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTANEIFYCTFRRLDPEENHTAELVIPELPLAHPPNER

SEQ ID NO: 1897 - protein, 220 aa, Artificial Sequence
  PD-L1 ECD v146
FTVTVPKDLYVVEYGSNMTIECNFPVEKQLDLAALIVYWEMEDKDIIQFVHGEEDLKVQHSSYRQRARLLKDQLSLGNAALQITDVKLQDAGVYRCMISYGGADYKRITVKVNAPYNKINQRISVVDPVTSEHELTCQAEGYPKAEVIWTSSDHQVLSGKTTTTNSTREEKLFNVTSTLRINTTTNEIFYCTFRGLDPEENHTAELVIPELPLAHPPNER

SEQ ID NO: 1898 - protein, 220 aa, Artificial Sequence
  PD-L1 ECD v147
FTVTVPKDLYVVEYGSNMTIECNFPVEKQLDLAALIVYWEMEDKDIIQFVHGEEDLKVQHSSYRQRARLLKDRLSLGNAALQITDVKLQDAGVYRCMISYGGADYKRITVKVNAPYNKINQRILVVDPVTSEHELTCQAEGYPKAEVIWTSSDHQVLSGKTTITNSKREEKLFNVTSTLRINTTTNEIFYCTFRRLDPEENHTAELVIPELPLAHPPNER

SEQ ID NO: 1899 - protein, 220 aa, Artificial Sequence
  PD-L1 ECD v148
FTVTVPKDLYVVEYGSNMTIECKFPVEEQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIRTSSDHQVLGGKTTTTNSKREEKLFNVTSTLRINTTTNEIFYCTFRRLDTEENHTAELVIPELPLAHPPNER

SEQ ID NO: 1900 - protein, 220 aa, Artificial Sequence
  PD-L1 ECD v149
FTVTVPKDLYVVEYGSNMTIECKFPVERQLDLAALIVYWEMEDKDIIQFVHGEEDLEVQHSSYRQRARLLKDQLSLGNAALQITDVKLQDAGVYRCMVSYGGADYKRITVKVNAPYNKINQRILVVDPVTSEHELTCQAEGYPKAEVIWTSSDHQVLSGKTTTTNSKREEKLFNVTSTLRINTTTNEIFYCTFRSLDPEENHTAELVIPELPLAHPPNER

SEQ ID NO: 1901 - protein, 220 aa, Artificial Sequence
  PD-L1 ECD v150
FTVTVPKDLYVVEYGSNMTIECKFPVERQLDLAALIVYWEMEDKDIIQFVHGEEDLKVQHSSYRQRARLLKDQLSLGNAALQITDVKLQDAGVYRCMISYGGADYKRITVKVNAPYNKINQRILVVDPDTSEHELTCQAEGYPKAEVIWTSSDHQVLSGKTTNTNSKREEKLFNVTSTLRINTTTNEIFYCTFRTLDPEENHTAELVIPELPLAHPPNER

SEQ ID NO: 1902 - protein, 220 aa, Artificial Sequence
  PD-L1 ECD v151
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEENHTAELVIPELPLAHPPNER

SEQ ID NO: 1903 - protein, 220 aa, Artificial Sequence
  PD-L1 ECD v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 1904 - protein, 220 aa, Artificial Sequence
  PD-L1 ECD v153
FTVTVPKDLYVVEYGSNMTIECKFPVEKQLDLAALIVYWEMEDKDIIQFVHGEEDLKVQHSSYRQRALLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTTNEIFYCTFRRLGSEENHTAELVIPELPLAHPPNER

SEQ ID NO: 1905 - protein, 220 aa, Artificial Sequence
  PD-L1 ECD v154
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVVWTSSDHQVLSGKTTTTNSKREEKLFNVTSTLRINTTTNEIFYCTFRGLDPEEDHTAELVIPELPLAHPPNER

SEQ ID NO: 1906 - protein, 220 aa, Artificial Sequence
  PD-L1 ECD v155
FTVTVPKDLYVVEYGSNMTIECKFPVEKQLDLAALIVYWEKEGEDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRGLDPEEDHTAELVIPELPLAHPPNER

SEQ ID NO: 1907 - protein, 220 aa, Artificial Sequence
  PD-L1 ECD v156
FTVTVPKDLYVVEYGSNMTIECKFPVEKQLDLAALIVYWEMEDKDIIQFAHGEEDLKVQHSSYRQRARLLKDQLSLGNAALQITDVKLQDAGVYRCMISYGGADYKRITVKVNAPYNKINQRISVVDPVTSEHELTCQAEGYPEAEVIWTSSDHQVLSGKTTTTNSKREEKLFNVTSTPRINTTTNEIFYCTFRGLDPEENHTAELVIPELPLAHPPNER

SEQ ID NO: 1908 - protein, 107 aa, Artificial Sequence
  PD-L1 IgV v67
PKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKV

SEQ ID NO: 1909 - protein, 107 aa, Artificial Sequence
  PD-L1 IgV v75
PKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKV

SEQ ID NO: 1910 - protein, 107 aa, Artificial Sequence
  PD-L1 IgV v80
PKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKV

SEQ ID NO: 1911 - protein, 107 aa, Artificial Sequence
  PD-L1 IgV v81
PKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEV

SEQ ID NO: 1912 - protein, 107 aa, Artificial Sequence
  PD-L1 IgV v82
PKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKV

SEQ ID NO: 1913 - protein, 107 aa, Artificial Sequence
  PD-L1 IgV v87
PKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKV

SEQ ID NO: 1914 - protein, 107 aa, Artificial Sequence
  PD-L1 IgV v94
PKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEV

SEQ ID NO: 1915 - protein, 107 aa, Artificial Sequence
  PD-L1 IgV v98
PKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEV

SEQ ID NO: 1916 - protein, 107 aa, Artificial Sequence
  PD-L1 IgV v100
PKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEV

SEQ ID NO: 1917 - protein, 107 aa, Artificial Sequence
  PD-L1 IgV v102
PKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 1918 - protein, 107 aa, Artificial Sequence
  PD-L1 IgV v103
PKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKV

SEQ ID NO: 1919 - protein, 107 aa, Artificial Sequence
  PD-L1 IgV v110
PKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKV

SEQ ID NO: 1920 - protein, 107 aa, Artificial Sequence
  PD-L1 IgV v118
PKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKV

SEQ ID NO: 1921 - protein, 107 aa, Artificial Sequence
  PD-L1 IgV v127
PKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKV

SEQ ID NO: 1922 - protein, 107 aa, Artificial Sequence
  PD-L1 IgV v152
PKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKV

SEQ ID NO: 1923 - protein, 114 aa, Artificial Sequence
  PD-L1 IgV v67
FTVTVPKDLYVVEYGSNMTIECKFPVEKQLDLAALIVYWEMEDKNIIQFVHGEEDLRVQHSSYRQRARLLKDQLSLGNAALQITDVKLQDAGVYRCMIGYGGADYKRITVKVNA

SEQ ID NO: 1924 - protein, 114 aa, Artificial Sequence
  PD-L1 IgV v75
FTVTVPKDLYVVEYGSNMTIECKFPVEIQLDLAALIVYWEMEDKNIIQFVHGEEDLKVQHSSYRQRARLLKDQLSLGNAALQITDVKLQDAGVYRCMIGYGGADYKRITVKVNA

SEQ ID NO: 1925 - protein, 114 aa, Artificial Sequence
  PD-L1 IgV v80
FTVTVPKDLYVVEYGSNMTIECKFPVEKQLDLAALIVYWEMEDKNIIQFVHGEEVLKVQHSSYRQRARLLKDQLSLGNAALQITDVKLQDAGVYRCLIGYGGADYKRITVKVNA

SEQ ID NO: 1926 - protein, 114 aa, Artificial Sequence
  PD-L1 IgV v81
FTVTVPKDLYVVEYGSNMTIECKFPVGKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 1927 - protein, 114 aa, Artificial Sequence
  PD-L1 IgV v82
FTVTVPKDLYVVEYGSNMTIECKFPVEKQLDLAALIVYWEMEDKNIIQFVHGEGDLKVQHSSYRQRARLLKDQLSLGNAALQITDVKLQDAGVYRCLIGYGGADYKRITVKVNA

SEQ ID NO: 1928 - protein, 114 aa, Artificial Sequence
  PD-L1 IgV v87
FTVTVPKDLYVVEYGSNMTIECKFPVEKQLDLAALSVYWEMEDKNIIQFVHGEEDLKVQHSSYRQRARLLKDQLSLGNAALQITDVKLQDAGVYRCLISYGGADYKRITVKVNA

SEQ ID NO: 1929 - protein, 114 aa, Artificial Sequence
  PD-L1 IgV v94
FTVTVPKDLYVVEYGSNMTIECKFPVEKQLDLAALTVYWEMEDKNIIQFVHGEEDLKVQHSSYRQRARLLKDQLSLGNAALQITDVKLQDAGVYRCLISYGGADYKRITVEVNA

SEQ ID NO: 1930 - protein, 114 aa, Artificial Sequence
  PD-L1 IgV v98
FTVTVPKDLYVVEYGSNMTIECKFPVEKQLDLAAPSVYWEMEDKNIIQFVHGEEDLKVQHSSYRQRARLLKDQLSLGNAALQITDVKLQDAGVYRCLISYGGADYKRITVEVNA

SEQ ID NO: 1931 - protein, 114 aa, Artificial Sequence
  PD-L1 IgV v100
FTVTVPKDLYVVEYGSNTTIECKFPVEKQLDLAALTVYWEMEDKNIIQFVHGEENLKVQHSSYRQRARLLKDQLSLGNAALQITDVKLQDAGVYRCLISYGGADYKRITVEVNA

SEQ ID NO: 1932 - protein, 114 aa, Artificial Sequence
  PD-L1 IgV v102
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 1933 - protein, 114 aa, Artificial Sequence
  PD-L1 IgV v103
FTVTVPKDLYVVEYGSDMTIECKFPVEKQLDLAALIVYWEMEDKNIIQFVHGEEDLKVQHSSYRQRARLLKDQLSLGNAALQITDVKLQDAGVYRCLIGYGGADYKRITVKVNA

SEQ ID NO: 1934 - protein, 114 aa, Artificial Sequence
  PD-L1 IgV v110
FTVTVPKDLYVVEYGSNMTIECKFPVEKQLDLAALIVYWEMEDKDIIQFVHGEEDLKVQHSSYRQRARLLKDQLSLGNAALQITDVKLQDAGVYRCMISYGGADYKRITVKVNA

SEQ ID NO: 1935 - protein, 114 aa, Artificial Sequence
  PD-L1 IgV v118
FTVTVPKDLYVVEYGSNMTIECKFPVEKQLDLAALIVYWEMEDKDIIQFVHGEEDLKDQHSSYRQRARLLKDQLSLGNAALQITDVKLQDAGVYRCMISYGGADYKRITVKVNA

SEQ ID NO: 1936 - protein, 114 aa, Artificial Sequence
  PD-L1 IgV v127
FTVTVPKDLYVVEYGSNMTIECKFPVEKQLDLAALIVYWEMEDKDIIQFVHGEEDLKVQHSSYRQRARLLKDQLSLGNAALQITDVKLRDAGVYRCMVSYGGADYKRITVKVNA

SEQ ID NO: 1937 - protein, 114 aa, Artificial Sequence
  PD-L1 IgV v152
FTVTVPKDLYVVEYGSNMTIECKFPVEKQLDLAALIVYWEKEGKDIIQFVHGEEDLKVQHSSYSQRARLLKDQLSLGNAALQITDVKLQDAGVYRCMIGYGGADYKRITVKVNA

SEQ ID NO: 1938 - protein, 231 aa, Artificial Sequence
  Fc (C5S (C220S), R77C, (R292C),  N82G (N297G), V87C (V302C), L232del (K447del))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1939 - protein, 231 aa, Artificial Sequence
  Fc with C220S/L234A/L235E/G237A/K447del
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1940 - protein, 230 aa, Artificial Sequence
  Fc with C220S/E233P/L234V/L235A/G236del/S267K/K447del
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1941 - protein, 7 aa, Artificial Sequence
  Linker
GSGGGGS

SEQ ID NO: 1942 - protein, 5 aa, Artificial Sequence
  4GS Linker
GGGGS

SEQ ID NO: 1943 - protein, 221 aa, Artificial Sequence
  PD-L1 ECD v1
FTVTVPKDLYVVEYGSNMTIECKFPVENQLDLAALIVYWEVEDKTIIQFVNGEEDLEVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1944 - protein, 221 aa, Artificial Sequence
  PD-L1 ECD v2
FTVTVPKDLYVVEYGSNMTLECKFPVEKQLDLAALTVYWEMEDKDITQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1945 - protein, 221 aa, Artificial Sequence
  PD-L1 ECD v3
FTVTVPKDLYVVEYGSNMTLECKFPVEKQLDLAALIVYWEKEDENIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1946 - protein, 221 aa, Artificial Sequence
  PD-L1 ECD v4
FTVTVSKDLYVVEYGSNMTIECKFPVEKQLDLAALIVYWEMEDKTIIQFVHGEEDLKVQHSSYRQRARLLKDQLSLGIAALQTTDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1947 - protein, 221 aa, Artificial Sequence
  PD-L1 ECD v5
FTVTVPKDLYVVEYGSNMTIECKFPVEKQLDLAALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1948 - protein, 221 aa, Artificial Sequence
  PD-L1 ECD v6
FTVTVPKDLYVVEYGSNMTIECKFPVEKQLDLAALIVYWEKEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1949 - protein, 221 aa, Artificial Sequence
  PD-L1 ECD v7
FTVTVPKDLYVVEYGSNMTIECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1950 - protein, 221 aa, Artificial Sequence
  PD-L1 ECD v8
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1951 - protein, 221 aa, Artificial Sequence
  PD-L1 ECD v9
FTVTVPKDLYVVEYGSNMTIECKFPVEKQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1952 - protein, 221 aa, Artificial Sequence
  PD-L1 ECD v10
FTVTVPKDLYVVEYGSNMTIECKFPVEKQLDLAALIVYWEKEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1953 - protein, 221 aa, Artificial Sequence
  PD-L1 ECD v11
FTVTVPKDLYVVEYGSNMTLECKFPVEKQLDLAALTVYWEMEDKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1954 - protein, 221 aa, Artificial Sequence
  PD-L1 ECD v12
FTVTVPKDLYVVEYGSDMTIECKFPVEKQLDLAALIVYWEMEDKTIIQFAHGEEDLKVQHSSYRQRARLLKGQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1955 - protein, 221 aa, Artificial Sequence
  PD-L1 ECD v13
FTVTVPKDLYVVEYGSNMTLECKFPVEKQLDLAALIVYWEMEDKNIIQSVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1956 - protein, 221 aa, Artificial Sequence
  PD-L1 ECD v14
FTVTVPKDLYVVEYGSNMTIECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1957 - protein, 221 aa, Artificial Sequence
  PD-L1 ECD v15
FTVTVPKDLYVVEYGSNMTLECKFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1958 - protein, 221 aa, Artificial Sequence
  PD-L1 ECD v16
FTVTVPKDLYVVEYGSNMTLECKFPVEKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1959 - protein, 221 aa, Artificial Sequence
  PD-L1 ECD v17
FTVTVPKDLYVVEYGSNMTIECKFPVEKQLDLAALIVYWEVEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1960 - protein, 221 aa, Artificial Sequence
  PD-L1 ECD v18
FTVTVPKDLYVVEYGSNMTIECKFPVEKQLDLAALIVYWEKEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1961 - protein, 221 aa, Artificial Sequence
  PD-L1 ECD v19
FTVTVPKDLYVVEYGSNMTIECKFPVEKQLDLDALIVYWEMEDKNIIQFVHGEEDLKVQHSSYRQRARLLKDQLPLGNAALQITEVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1962 - protein, 221 aa, Artificial Sequence
  PD-L1 ECD v20
FTVTVPKDLYVVEYGSNITIECKFPVEKQLDLAALIVYWEKEGKNIIQFVRGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1963 - protein, 221 aa, Artificial Sequence
  PD-L1 ECD v21
FTVTVPKDLYEVEYGSNMTLECKFPVEKQLDLAALTVYWEMEDKDIIQFVHGEEDLKVQRSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1964 - protein, 221 aa, Artificial Sequence
  PD-L1 ECD v22
FTVTVPKDLYVVEYGSNMTIECKFPVEKQLDLDALIVYWEMEDKNIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1965 - protein, 221 aa, Artificial Sequence
  PD-L1 ECD v23
FTVTVPKDLYVVEYGGNMTIECKFPVEKQLDLDALIVYWEMEDKNIIQFVHGEEDLKVQHSSYRQRARLLEDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1966 - protein, 221 aa, Artificial Sequence
  PD-L1 ECD v24
FTVTVPKDLYVVEYGSNMTIECKFPVGKQLDLAALIVYWEMEDKTIIQFVHGEEDLKVQHSSYRQRARLLKDQLSLGNAALQITDVKLQDAGVYRCIISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1967 - protein, 221 aa, Artificial Sequence
  PD-L1 ECD v25
FTVTVPKDLYVVEYGSNMTIECKFPVGKQLDLAALIVYWEMEDKTIIQFVHGEEDLRVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1968 - protein, 221 aa, Artificial Sequence
  PD-L1 ECD v26
FTVTVPKDLYVVEYGSNMTIECKFPVEKQLDLDALIVYWEMEDKNIIQFVHGVEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1969 - protein, 221 aa, Artificial Sequence
  PD-L1 ECD v27
FTVTVPKDLYVVEYGSNMTIECKFPVEKQLDLAALIVYWEMEGKDIIQFVHGEEDLKAQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1970 - protein, 221 aa, Artificial Sequence
  PD-L1 ECD v28
FTVTVPKDLYVVEYGSNMTIECKFPVEKQLDLAALIVYWGMEVKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1971 - protein, 221 aa, Artificial Sequence
  PD-L1 ECD v29
FTVTVPKDLYVVESGSNMTIECKFPVEEQLDLAALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1972 - protein, 221 aa, Artificial Sequence
  PD-L1 ECD v30
FTVTVPKDLYVVEYGSNMTIECKFPVEKQLDLDALIVYWEMEDKNIIQFVHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1973 - protein, 221 aa, Artificial Sequence
  PD-L1 ECD v31
FTVTVPKDLYVVEYGSNMTIECKFPVEKQLDLDALIVYWEMEDKNIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1974 - protein, 221 aa, Artificial Sequence
  PD-L1 ECD v32
FTVTVPKDLYVVEYGSNMTIECKFPVEKQLDLDALIVYWEMEDKTIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1975 - protein, 221 aa, Artificial Sequence
  PD-L1 ECD v33
FTVTVPKDLYVVEYGSNMTIECKFPVEKQLDLDALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1976 - protein, 221 aa, Artificial Sequence
  PD-L1 ECD v34
FTVTVPKDLYVVEYGSNMTIECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1977 - protein, 221 aa, Artificial Sequence
  PD-L1 ECD v35
FTVTVPKDLYVVEYGSNMTIECKFPVEKQLDLAALIVYWEMEDKTIIQFAHGEEDLKVQHSSYRQRARLLKDQLSLGSAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1978 - protein, 221 aa, Artificial Sequence
  PD-L1 ECD v36
FTVTVPKDLYVVEYGSNMTLECKFPVEKQLDLAALIVYWEMEDKTIIQFVHGEEDLKVQHSSYRQRARLLKDQLSLGNAALQITDVKLQDAGVYRCMISYGGADYKRITMKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1979 - protein, 221 aa, Artificial Sequence
  PD-L1 ECD v37
FTVTVPKDLYVVEYGSNMTLECKFPVEKQLDLAALTVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1980 - protein, 221 aa, Artificial Sequence
  PD-L1 ECD v38
FTVTVPKDLYVVEYGSNMTIECKFPVEKQLDLAALIVYWEMEDKTIIQFVHGEEDLKVQHSSYRQRARLLKDQPPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1981 - protein, 221 aa, Artificial Sequence
  PD-L1 ECD v39
FTVTVPKDLYVVEYGSNMTIECKFPVEKQLDLAALIVYWEMEDKTIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1982 - protein, 221 aa, Artificial Sequence
  PD-L1 ECD v40
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYRRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1983 - protein, 221 aa, Artificial Sequence
  PD-L1 ECD v41
FTVTVPKDLYVVEYGSNMTIECKFPVEKQLDLAALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1984 - protein, 221 aa, Artificial Sequence
  PD-L1 ECD v42
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCVISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1985 - protein, 221 aa, Artificial Sequence
  PD-L1 ECD v43
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGAGYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1986 - protein, 221 aa, Artificial Sequence
  PD-L1 ECD v44
FTVTVPKDLYVVEYGSNMTIECKFPVEKQLDLDALIVYWEMEDKNIIQFVHGEEDLKVQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1987 - protein, 221 aa, Artificial Sequence
  PD-L1 ECD v45
FTVTVPKDLYVVEYGSNMTLECKFPVGKQLDLAALIVYWEMEDKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1988 - protein, 221 aa, Artificial Sequence
  PD-L1 ECD v46
FTVTVPKDLYVVEYGSNMTLECKFPVGKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1989 - protein, 221 aa, Artificial Sequence
  PD-L1 ECD v47
FTVTVPKDLYVVEYGSNMTLECKFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1990 - protein, 221 aa, Artificial Sequence
  PD-L1 ECD v48
FTVTVPKDLYVVEYGSNMTLECKFPVEKQLDLDALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1991 - protein, 221 aa, Artificial Sequence
  PD-L1 ECD v49
FTVTVPKDLYVVEYGSNMTLECKFPVEKQLDLAALIVYWEMEGKDIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1992 - protein, 221 aa, Artificial Sequence
  PD-L1 ECD v50
FTVTVPKDLYVVEYGSNMTIECKFPVGKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1993 - protein, 221 aa, Artificial Sequence
  PD-L1 ECD v51
FTVTVPKDLYVVEYGSNMTIECKFPVEKQLDLAALIVYWEMEDKTIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1994 - protein, 221 aa, Artificial Sequence
  PD-L1 ECD v52
FTVTVPKDLYAVEYGSNMTLECKFPVGKQLDLAALIVYWEMEGKDIIQFVYGEEDLKVQHSSYRQRARLLKDQLSLGNAALQITDVKLQDAGVYRCMIGYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1995 - protein, 221 aa, Artificial Sequence
  PD-L1 ECD v53
FTVTVPKDLYVVEYGSNMTLECKFPVGKQLDLAALIVYWEMEGKTIIQFAHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1996 - protein, 221 aa, Artificial Sequence
  PD-L1 ECD v54
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1997 - protein, 221 aa, Artificial Sequence; identical to SEQ ID NO: 1953
  PD-L1 ECD v55

SEQ ID NO: 1998 - protein, 221 aa, Artificial Sequence
  PD-L1 ECD v56
FTVTVPKDLYVVEYGSNMTLECKFPVEEQLDLAALIVYWEMEGKDIIQFVHGGEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 1999 - protein, 221 aa, Artificial Sequence
  PD-L1 ECD v57
FTVTVPKDLYVVEYGSNMTIECKFPVEKQLDLDALIVYWEMEGKDIIQFVHGEEDLKAQHSSYRQRARLLKDQLPLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2000 - protein, 221 aa, Artificial Sequence
  PD-L1 ECD v58
FTVTVPKDLYVVEYGSNMTIECRFPVEKQLDLAALIVYWEMEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2001 - protein, 221 aa, Artificial Sequence
  PD-L1 ECD v59
FTVTVPKDLYVVEYGSNMTLECKFPVEKQLDLAALIVYWEMEGKDIIQFVHGEEDLKAQHSSYRQRARLLKDQLSLGIAALQITDVKLQGAGVYRCMISYDGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2002 - protein, 222 aa, Artificial Sequence
  PD-L1 ECD v60
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2003 - protein, 221 aa, Artificial Sequence
  PD-L1 ECD v61
FTVTVPKDLYVVEYGSNMTLECEFPVEKQLDLAALIVYWEMEGKDIIQFVHGEEDLKAQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2004 - protein, 221 aa, Artificial Sequence
  PD-L1 ECD v62
FTVTVPKDLYVVEYGSNMTLECEFPVEKQLDLAALIVYWEMEGKDIIQFAHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2005 - protein, 221 aa, Artificial Sequence
  PD-L1 ECD v63
FTVTVPKDLYVVEYGSNMIIECKFPVGKQLDLAALIVYWEMEDKIIIQFAHGEEDLKVQHSSYRQRARLLKDQLSLGIAALQITDVKLQDAGVYRCKISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2006 - protein, 221 aa, Artificial Sequence
  PD-L1 ECD v64
FTVTVPKDLYVVEYGSNMTLECKFPVEKQLDLAALIVYWEKEGKDIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2007 - protein, 221 aa, Artificial Sequence
  PD-L1 ECD v65
FTVTVPKDLYVVEYGSNMTIECRFPVEKQLDLAALIVYWEMEDKTIIQFVHGEEDLKVQHSSYRQRARLLKDQLSLGIAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2008 - protein, 222 aa, Artificial Sequence
  PD-L1 ECD v66
FTVTVPKDLYVVEYGSNMTLECKFPVEEQLDLAALIVYWEMEGKDIIQFVHGEEDLKAQHSSYRQRARLLKDQLSLGNAALQITDVKLRDAGVYRCMISYGGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERT

SEQ ID NO: 2009 - protein, 19 aa, Artificial Sequence
  Signal Peptide
MGSTAILALLLAVLQGVSA

SEQ ID NO: 2010 - protein, 8 aa, Artificial Sequence
  Flag tag
DYKDDDDK

SEQ ID NO: 2011 - protein, 6 aa, Artificial Sequence
  His tag
HHHHHH

SEQ ID NO: 2012 - protein, 133 aa, Artificial Sequence
  Wildtype PD-L1 SIP
MGSTAILALLLAVLQGVSAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNA

SEQ ID NO: 2013 - protein, 134 aa, Artificial Sequence
  PD-L1 v60 SIP
MGSTAILALLLAVLQGVSAFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 2014 - protein, 68 aa, Artificial Sequence
  CD8 hinge and transmembrane domain
KPTTTPAPRPPTPAPTIASQPLSLRPEACRPAAGGAVHTRGLDFACDIYIWAPLAGTCGVLLLSLVIT

SEQ ID NO: 2015 - protein, 431 aa, Artificial Sequence
  antiCD19 chimeric antigen receptor CAR-2
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2016 - protein, 707 aa, Artificial Sequence
  antiCD19 chimeric antigen receptor CAR-2
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 2017 - DNA, 8708 bp, Artificial Sequence
  anti-CD19 chimeric antigen receptor CAR-2
agcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagaagcttgatatcgaattcccacggggttggacgcgtaggaacagagaaacaggagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacttccatagaaggatcccctgcaggtaatacgactcactatagggtccactgccgccaccatggctctgcctgtgacagctctgctgctgcctctggccctgctgctccatgccgccagacccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcgccaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagtggcgagggcagaggaagtctgctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgca

SEQ ID NO: 2018 - protein, 428 aa, Artificial Sequence
  antiCD19 chimeric antigen receptor CAR-1
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 2019 - protein, 706 aa, Artificial Sequence
  antiCD19 chimeric antigen receptor CAR-1
MALPVTALLLPLALLLHAARPGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2020 - protein, 232 aa, Artificial Sequence
  Blue fluorescent protein
SRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 2021 - protein, 18 aa, Artificial Sequence
  T2A
EGRGSLLTCGDVEENPGP

SEQ ID NO: 2022 - protein, 238 aa, Artificial Sequence
  ICOSL v1 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2023 - protein, 238 aa, Artificial Sequence
  ICOSL v2 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2024 - protein, 238 aa, Artificial Sequence
  ICOSL v3 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2025 - protein, 238 aa, Artificial Sequence
  ICOSL v4 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 2026 - protein, 238 aa, Artificial Sequence
  ICOSL v5 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2027 - protein, 238 aa, Artificial Sequence
  ICOSL v6 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGCPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2028 - protein, 238 aa, Artificial Sequence
  ICOSL v7 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2029 - protein, 238 aa, Artificial Sequence
  ICOSL v8 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTDTSINGYPRPNVYWINKTDNSLLDQALQNDTVFLNMRGLYDVVSVLRIARTPSVNIGCCIENVLLQQNLTVGSQTGNDIGERDKIAENPVSTGEKNAAT

SEQ ID NO: 2030 - protein, 238 aa, Artificial Sequence
  ICOSL v9 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKIAENPVSTGEKNAAT

SEQ ID NO: 2031 - protein, 238 aa, Artificial Sequence
  ICOSL v10 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2032 - protein, 238 aa, Artificial Sequence
  ICOSL v11 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2033 - protein, 238 aa, Artificial Sequence
  ICOSL v12 ECD
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2034 - protein, 238 aa, Artificial Sequence
  ICOSL v13 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2035 - protein, 238 aa, Artificial Sequence
  ICOSL v14 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2036 - protein, 238 aa, Artificial Sequence
  ICOSL v15 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHGPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2037 - protein, 238 aa, Artificial Sequence
  ICOSL v16 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2038 - protein, 238 aa, Artificial Sequence
  ICOSL v17 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2039 - protein, 238 aa, Artificial Sequence
  ICOSL v18 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2040 - protein, 238 aa, Artificial Sequence
  ICOSL v19 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPPSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2041 - protein, 238 aa, Artificial Sequence
  ICOSL v20 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSPLDQALQNDTVFLNMRGLYDVVSVLRIARTPSVNIGCRIENVLLQQNLTVGSQTGNDIGERDKITENPVSTGEKNAAT

SEQ ID NO: 2042 - protein, 238 aa, Artificial Sequence
  ICOSL v21 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVELHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2043 - protein, 238 aa, Artificial Sequence
  ICOSL v22 ECD
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2044 - protein, 238 aa, Artificial Sequence
  ICOSL v23 ECD
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2045 - protein, 238 aa, Artificial Sequence
  ICOSL v24 ECD
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNPTVGSQTGNDIGERDKITENPVSTGEKNAAT

SEQ ID NO: 2046 - protein, 238 aa, Artificial Sequence
  ICOSL v25 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVHWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2047 - protein, 238 aa, Artificial Sequence
  ICOSL v26 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNAYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2048 - protein, 238 aa, Artificial Sequence
  ICOSL v27 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSTNGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2049 - protein, 238 aa, Artificial Sequence
  ICOSL v28 ECD
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2050 - protein, 238 aa, Artificial Sequence
  ICOSL v29 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVHWINKTDNSLLDQALQNDTVFLNMRGLYDVVSVLRIARTPSVNIGCCIESVLLQQNLTVGSQTGNDIGERDKITENPVSTGEKNAAT

SEQ ID NO: 2051 - protein, 238 aa, Artificial Sequence
  ICOSL v30 ECD
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 2052 - protein, 238 aa, Artificial Sequence
  ICOSL v31 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTGNSLLDQALQNDTVFLNMRGLYDVVSVLRIARTPSVNIGCCIENVLLQQNLTVGSQTGNDIGERDKITENPVSTGEKNAAT

SEQ ID NO: 2053 - protein, 238 aa, Artificial Sequence
  ICOSL v32 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSHDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2054 - protein, 238 aa, Artificial Sequence
  ICOSL v33 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2055 - protein, 238 aa, Artificial Sequence
  ICOSL v34 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2056 - protein, 111 aa, Artificial Sequence
  ICOSL WT IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVE

SEQ ID NO: 2057 - protein, 111 aa, Artificial Sequence
  ICOSL v1 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVE

SEQ ID NO: 2058 - protein, 111 aa, Artificial Sequence
  ICOSL v2 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVE

SEQ ID NO: 2059 - protein, 111 aa, Artificial Sequence
  ICOSL v3 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVE

SEQ ID NO: 2060 - protein, 111 aa, Artificial Sequence
  ICOSL v4 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVE

SEQ ID NO: 2061 - protein, 111 aa, Artificial Sequence
  ICOSL v5 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVE

SEQ ID NO: 2062 - protein, 111 aa, Artificial Sequence
  ICOSL v10 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVE

SEQ ID NO: 2063 - protein, 111 aa, Artificial Sequence
  ICOSL v11 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVE

SEQ ID NO: 2064 - protein, 111 aa, Artificial Sequence
  ICOSL v12 IgV
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVE

SEQ ID NO: 2065 - protein, 111 aa, Artificial Sequence
  ICOSL v13 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVE

SEQ ID NO: 2066 - protein, 111 aa, Artificial Sequence
  ICOSL v14 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVE

SEQ ID NO: 2067 - protein, 111 aa, Artificial Sequence
  ICOSL v22 IgV
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVE

SEQ ID NO: 2068 - protein, 111 aa, Artificial Sequence
  ICOSL v23 IgV
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVE

SEQ ID NO: 2069 - protein, 111 aa, Artificial Sequence
  ICOSL v24 IgV
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVE

SEQ ID NO: 2070 - protein, 111 aa, Artificial Sequence
  ICOSL v28 IgV
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVE

SEQ ID NO: 2071 - protein, 111 aa, Artificial Sequence
  ICOSL v30 IgV
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVE

SEQ ID NO: 2072 - protein, 111 aa, Artificial Sequence
  ICOSL v33 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVE

SEQ ID NO: 2073 - protein, 111 aa, Artificial Sequence
  ICOSL v34 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVE

SEQ ID NO: 2074 - protein, 238 aa, Artificial Sequence
  ICOSL v35 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2075 - protein, 111 aa, Artificial Sequence
  ICOSL v35 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVE

SEQ ID NO: 2076 - protein, 238 aa, Artificial Sequence
  ICOSL v36 ECD
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2077 - protein, 238 aa, Artificial Sequence
  ICOSL v37 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2078 - protein, 238 aa, Artificial Sequence
  ICOSL v38 ECD
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2079 - protein, 238 aa, Artificial Sequence
  ICOSL v39 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2080 - protein, 238 aa, Artificial Sequence
  ICOSL v40 ECD
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2081 - protein, 238 aa, Artificial Sequence
  ICOSL v41 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2082 - protein, 238 aa, Artificial Sequence
  ICOSL v42 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFGVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2083 - protein, 238 aa, Artificial Sequence
  ICOSL v43 ECD
DTQEKEVRAMVGSDVELSCVCPEGSRFDLNDVYVYWQTSESKTVVTYHIPQHSSLEYVDSRYRNRALMSPAGMLRGDFSLRLFNVTPQDEQKFHCLVLSRSLGFQEVLGVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2084 - protein, 238 aa, Artificial Sequence; identical to SEQ ID NO: 2026
  ICOSL v44 ECD

SEQ ID NO: 2085 - protein, 238 aa, Artificial Sequence
  ICOSL v45 ECD
DTQEKEVRAMVGSDVELSCACPEGSRFDLNDVYVYWQTSESKTVVTYHIPQHSSLEYVDSSYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFSNMRGLYDVVSVLRIARTPSVNIGCCIENVLLQQNLTVGSQTGNDIGERDKITENPVSTGEKNAAT

SEQ ID NO: 2086 - protein, 238 aa, Artificial Sequence
  ICOSL v46 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSAPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2087 - protein, 238 aa, Artificial Sequence
  ICOSL v47 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 2088 - protein, 238 aa, Artificial Sequence
  ICOSL v48 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2089 - protein, 238 aa, Artificial Sequence
  ICOSL v49 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2090 - protein, 238 aa, Artificial Sequence
  ICOSL v50 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLALSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2091 - protein, 238 aa, Artificial Sequence
  ICOSL v51 ECD
DTQEKEVRAMVGSDVELSCACPEGSRFDLNDVYVYWQTSESKTVVTYHIPQSSSLENVDSRYRNRALMSPARMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2092 - protein, 238 aa, Artificial Sequence
  ICOSL v52 ECD
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVEVTLHVTANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2093 - protein, 238 aa, Artificial Sequence
  ICOSL v53 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGGRDKITENPVSTGEKNAAT

SEQ ID NO: 2094 - protein, 238 aa, Artificial Sequence
  ICOSL v54 ECD
DTQEKEVRAMVGSDVELSCACPEGSRFDLNDVYVYWQTSESKTVVTHHIPQSSSLENVDSRYRNRALMSPAGMLRGDFSLRLFNVTPQDEQKFHCLVLSQSLGFQEALSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2095 - protein, 238 aa, Artificial Sequence
  ICOSL v55 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPFQDELTFTCTSINGYPRPNVYWINKTDNSLLDQALQNDTVFLNTRGLYDVVSVLRIARTPSVNIGCCIENVLLQQNLTVGSQTGNDIGERDKITENPVSTGEKNAAT

SEQ ID NO: 2096 - protein, 238 aa, Artificial Sequence
  ICOSL v56 ECD
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAAT

SEQ ID NO: 2097 - protein, 238 aa, Artificial Sequence
  ICOSL v57 ECD
DTQEKEVRAMVGSDVELSCACPEGSRFDLNDVYVYWRTSESKTVVTYHIPQHSSLEYVDSRYRNRALMSPAGMLRGDFSLRLFNVTPQDEQKFHCLVLSRSLGFQEVLSNEVTLHVAANFSVPVVSAPHSPSQDELTFTCTFINGYPRPNVYWINKTDNSLLDQALQNDTVFLNMRGLYDVVSVLRIARTPSVNIGCRIENVLLQQNLTVGSQTGNVIGEGDKITENPVSTGEKNAAT

SEQ ID NO: 2098 - protein, 238 aa, Artificial Sequence
  ICOSL v58 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2099 - protein, 238 aa, Artificial Sequence
  ICOSL v59 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHAAANFSVPVVSAPHSPSQDELTFTCTSINGYPRPNVYWINKTDNSMLDQALQNDTVSLNMRGLYDVVSVLRIARTPGVNIGCRIENVLLQQNLTVGSQTGNDIGERDKITENPVSTGEKNAAT

SEQ ID NO: 2100 - protein, 238 aa, Artificial Sequence
  ICOSL v60 ECD
DTQEKEVRAMVGSDVELSCACPEGSRSDLNDVYVYWQTSESKTVVTYHIPQHSSLEYVDSRYRNRALMSPAGMLRGDFSLRLFNVTPQDEQKFHCLVLSQSLGFQEVLSNEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2101 - protein, 238 aa, Artificial Sequence
  ICOSL v61 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLNVEVTLHVAANFSVPVVSAPHSPSQDELTFTCTSINGYPRPNVYWINKTDNSLLDQAQQNDTVFLNMRGLYDVVSVLRIARTPSVNIGCCIENVLLQQNLTVGSQTGNDIGERDKITENPVSTGEKNAAT

SEQ ID NO: 2102 - protein, 238 aa, Artificial Sequence
  ICOSL v62 ECD
DTQEKEVRAMVGSDVELRCACPEGSRFDLNDVYVYWQTSESKTVVTYHIPQSSSLENVDSRYRNRALMSPAGMLRGDFSLRLFNVTPQDEQKLHCLVLSQSLGFQEVLSVEVTLHVAANFSVPVVSAPHSPSQDELTFTCTSVNGYPRPNVYWINKTDNSLLDQALQNDTVFLNMRGLYDVVSVLRIARTPSVNIGCCIENVLLQQNLTVGSQTGNDIGEGDKITENPVSTGEKNAAT

SEQ ID NO: 2103 - protein, 238 aa, Artificial Sequence
  ICOSL v63 ECD
DTQEKEVRAMVGSDVELSCTCPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGCPRPNVYWINKTDNSLLDLALQNDTVFLNMRGLYDVVSVLRIARTPSVNIGCCIENVLLQQNLTVGSQTGNDIGERDKITENPVSTGEKNAAT

SEQ ID NO: 2104 - protein, 238 aa, Artificial Sequence
  ICOSL v64 ECD
DTQEKEVRAMEGSDVELSCACPEGSRFDLDDVYVYWQTSESKTVVTYHIPQHSSLEYVDSRYRNRALMSPAGMLRGDFSLRLFNVTPQDEQKFECIVFSQSLGFQEVLSVEVTLHVAANFSVPVVSAPHSPSQDELTFTCTSINGYPRPNVYWINKTDNSLLDQALQNDTVFLNMRGLYDVVSVLRIARTPSVDIGCCIENVLLQQNLTAGSQTGNDTGERDKITENPVSTGEKNAAT

SEQ ID NO: 2105 - protein, 238 aa, Artificial Sequence
  ICOSL v65 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLSVEVTLHVAANFSMPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2106 - protein, 238 aa, Artificial Sequence
  ICOSL v66 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFECIVLSQSLGFQEVLSVEVTLHVAANISVPVVTAPHSPSQDELTFTCTSINGYPRPNVYRINKTDNSLLDQALQNDTVFLNMRGLYDVVSVLRIARTPSVNIGCCIENVLLQQNLTVGSQTGNDNGERDKITENPVSTGEKNAAT

SEQ ID NO: 2107 - protein, 238 aa, Artificial Sequence
  ICOSL v67 ECD
DTQEKEVRAVVGSDVELRCACPEGSRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVRAPHSPSQDELTFSCTSINGYPRPNVYWINKTDNSLLDQALQNDTVFLNMRGLYDVVSVLRIARTPSVNIGCCIENVFLQQNLTVGSQTGNDIGERDKITENPVSTGEKNAAT

SEQ ID NO: 2108 - protein, 238 aa, Artificial Sequence
  ICOSL v68 ECD
DTQEKEVRAMVGSDVELSCACPEGGRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITEKPVSTGEKNAAT

SEQ ID NO: 2109 - protein, 238 aa, Artificial Sequence
  ICOSL v69 ECD
DTQEKEVRAMVGSDVELSCACPEGSRFDLDDVYVYWQTSESKTVVTYHIPQSSSLENVDSRYRNRAPMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNGIGEKDKISENPVSTGEKNAAT

SEQ ID NO: 2110 - protein, 238 aa, Artificial Sequence
  ICOSL v70 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVTANFSVPVVSAPHSPSQDELTFTCTSINGYPRPNVYWINKTDNSLLDQALQNDTVFLNMRGLYDVVSVLRIARSPSVNIGCRIENVLLQQNLTVGSQTGNDIGERDKITENPVSTGEKNAAT

SEQ ID NO: 2111 - protein, 238 aa, Artificial Sequence
  ICOSL v71 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2112 - protein, 238 aa, Artificial Sequence
  ICOSL v72 ECD
DTQEKEVRAMVGSDVELSCACPEGGRCDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDKLTFTCTSINGYPRPNVYWINKTDNSLLDQALQNDTVFSNMRGLYDVVSVLRIARTPSVNIGCRIENVLLQQNLTVGSQTGNDIGERDKITENPVSTGEKNAAT

SEQ ID NO: 2113 - protein, 238 aa, Artificial Sequence
  ICOSL v73 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSAEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGEIDKITENPVSTGEKNAAT

SEQ ID NO: 2114 - protein, 238 aa, Artificial Sequence
  ICOSL v74 ECD
DTQEKEVRAIVGGDVELSCACPEGSRFDLNDVYVYWQTSESKTVVTYHIPQHSSLEYVDSRYRNRALMSPAGMLRGGFSLRLFNVTPQDEQKFHCLVLSQSLGFQEVLSAEVTLHVAANFSVPVVSAPPSPSQDELTFTCTSVNGYPRPNVYWINKTDNSLLDQALQNDTVSLNMRGLYDVVSVLRIARTPSMNIGCRIENVLLQQNLTVGSQTGNDIGERDKITENPVSTGEKNAAT

SEQ ID NO: 2115 - protein, 238 aa, Artificial Sequence
  ICOSL v75 ECD
DTQEKEVRAMVGSDVELSCACPEGSRFDLNDVYVYWQTSESKTVVTYHIPQHSSLEYVDSCFRNRALMSPAGMLRGDFSLRLFNVTPQDEQKFHCLVLSRSLGFQEVLSNEVTLHVAANSSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2116 - protein, 238 aa, Artificial Sequence
  ICOSL v76 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2117 - protein, 238 aa, Artificial Sequence
  ICOSL v77 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSIDGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2118 - protein, 238 aa, Artificial Sequence
  ICOSL v78 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECLVFSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2119 - protein, 238 aa, Artificial Sequence
  ICOSL v79 ECD
DTQEKEVRAMVGSDVELSCACPEGSRFDLNDVYVYWQTSESKTVVTYHIPQSSSLENVDSRYRNRALMSPAGMLRGDFSLRLFNVTPQDAQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2120 - protein, 238 aa, Artificial Sequence
  ICOSL v80 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2121 - protein, 238 aa, Artificial Sequence
  ICOSL v81 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSVNGYPRPNVYWINKTDNSLLDQALQNDTVFLNMRGLYDVVSVLRIARTPSVNIGCCIENVLLQQNLTVGSQTGNDIGERDKVTENPVSTGEKNAAT

SEQ ID NO: 2122 - protein, 111 aa, Artificial Sequence
  ICOSL v36 IgV
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVE

SEQ ID NO: 2123 - protein, 111 aa, Artificial Sequence
  ICOSL v37  IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDE

SEQ ID NO: 2124 - protein, 111 aa, Artificial Sequence
  ICOSL v38  IgV
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSRSLGFQEVLSDE

SEQ ID NO: 2125 - protein, 111 aa, Artificial Sequence
  ICOSL v39  IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVE

SEQ ID NO: 2126 - protein, 111 aa, Artificial Sequence
  ICOSL v40  IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSRSLGFQEVLSDE

SEQ ID NO: 2127 - protein, 111 aa, Artificial Sequence
  ICOSL v41  IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVE

SEQ ID NO: 2128 - protein, 111 aa, Artificial Sequence
  ICOSL v43  IgV
DTQEKEVRAMVGSDVELSCVCPEGSRFDLNDVYVYWQTSESKTVVTYHIPQHSSLEYVDSRYRNRALMSPAGMLRGDFSLRLFNVTPQDEQKFHCLVLSRSLGFQEVLGVE

SEQ ID NO: 2129 - protein, 111 aa, Artificial Sequence; identical to SEQ ID NO: 2061
  ICOSL v44  IgV

SEQ ID NO: 2130 - protein, 111 aa, Artificial Sequence
  ICOSL v48 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVE

SEQ ID NO: 2131 - protein, 111 aa, Artificial Sequence
  ICOSL v50 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLALSQSLGFQEVLSVE

SEQ ID NO: 2132 - protein, 111 aa, Artificial Sequence
  ICOSL v51  IgV
DTQEKEVRAMVGSDVELSCACPEGSRFDLNDVYVYWQTSESKTVVTYHIPQSSSLENVDSRYRNRALMSPARMLRGDFSLRLFNVTPQDEQKFHCLVLSQSLGFQEVLSVE

SEQ ID NO: 2133 - protein, 111 aa, Artificial Sequence
  ICOSL v60  IgV
DTQEKEVRAMVGSDVELSCACPEGSRSDLNDVYVYWQTSESKTVVTYHIPQHSSLEYVDSRYRNRALMSPAGMLRGDFSLRLFNVTPQDEQKFHCLVLSQSLGFQEVLSNE

SEQ ID NO: 2134 - protein, 111 aa, Artificial Sequence
  ICOSL v78  IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECLVFSRSLGFQEVLSVE

SEQ ID NO: 2135 - protein, 111 aa, Artificial Sequence
  ICOSL v79 IgV
DTQEKEVRAMVGSDVELSCACPEGSRFDLNDVYVYWQTSESKTVVTYHIPQSSSLENVDSRYRNRALMSPAGMLRGDFSLRLFNVTPQDAQKFHCLVLSQSLGFQEVLSVE

SEQ ID NO: 2136 - protein, 111 aa, Artificial Sequence
  ICOSL v80  IgV
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVE

SEQ ID NO: 2137 - protein, 238 aa, Artificial Sequence
  ICOSL v81 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGGQTGNDIGERDKITENPVSTGEKNAAT

SEQ ID NO: 2138 - protein, 238 aa, Artificial Sequence
  ICOSL v82 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2139 - protein, 238 aa, Artificial Sequence
  ICOSL v83 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVDIGCCIENVLLQQNLTVGSQTGNDIGERDKITENPVSTGEKNAAT

SEQ ID NO: 2140 - protein, 238 aa, Artificial Sequence
  ICOSL v84 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSDEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2141 - protein, 238 aa, Artificial Sequence
  ICOSL v85 ECD
DTQEKEVRAMVGSDVELSCACPEGSRFDLNDVYVYWQTSESKTVVTYHIPQSSPLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2142 - protein, 238 aa, Artificial Sequence
  ICOSL v86 ECD
DTQEKEVRAMVGSDVELSCACPEGSRFDLNDVYVYWQPSESKTVVTYHIPQSSSLEDVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2143 - protein, 237 aa, Artificial Sequence
  ICOSL v87 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2144 - protein, 237 aa, Artificial Sequence
  ICOSL v88 ECD
DTQEKEVRAMVGSDVELSCACPEGSRFDLNDVVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2145 - protein, 237 aa, Artificial Sequence
  ICOSL v89 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTTSINGYPRPNVYWINKTDNSLLDQALQNDTVFLNMRGLYDVVSVLRIARTPSVNIGCCIENVLLQQNLTVGSQTGNDIGERDKIAENPVSTGEKNAAT

SEQ ID NO: 2146 - protein, 238 aa, Artificial Sequence
  ICOSL v90 ECD
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2147 - protein, 238 aa, Artificial Sequence
  ICOSL v91  ECD
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSPSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2148 - protein, 238 aa, Artificial Sequence
  ICOSL v92 ECD
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSQSLGFQEVLSDEVTLHVAANFSVPVVSAPHSPSQDELTFTCTSINGYPRPNVYWINKTDNSLLDQALQNDTVFLNMRGLYDVVSVLRIARTPGVNIGCCIENVLLQQNLTVGSQTGNDIGERDKITENPVSTGEKNAAT

SEQ ID NO: 2149 - protein, 238 aa, Artificial Sequence
  ICOSL v93 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFGVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2150 - protein, 238 aa, Artificial Sequence
  ICOSL v94 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITEKPVSTGEKNAAT

SEQ ID NO: 2151 - protein, 238 aa, Artificial Sequence
  ICOSL v96 ECD
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVEVTLHVTANFSVPVVSAPHSPSQDELTFTCTSINGYPRPNVYWINKTDNSLLDQALQNDTVFLNMRGLYDVVSVLRIARAPSVNIGCRIENVLLQQNLTVGSQTGNDIGERDKITENPVSTGEKNAAT

SEQ ID NO: 2152 - protein, 238 aa, Artificial Sequence
  ICOSL v96 ECD
DTQEKEVRAMVGSDVELSCACPEGSRFDLNDVYVYWQTSESKAVVTYHIPQHSSLEYVDSRYRNRALMSPAGMQRGDFSLRLFNVTPQGEQKFHCLVLSQSLGFQEVLSDEVTLHVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 2153 - protein, 238 aa, Artificial Sequence; identical to SEQ ID NO: 2095
  ICOSL v97 ECD

SEQ ID NO: 2154 - protein, 238 aa, Artificial Sequence
  ICOSL v98 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEILSDEVTLHVAANFSVPVVSAPHSPSQDELTFTCTSINGYPRPNVYWFNKTDNSLLDQALQNDTVFLNMRGLYDVVSVLRIARTPSVNIGCRIENVLLQQNLTVGSQTGNDIGEGDKITENPVSTGEKNAAT

SEQ ID NO: 2155 - protein, 111 aa, Artificial Sequence
  ICOSL v85  IgV
DTQEKEVRAMVGSDVELSCACPEGSRFDLNDVYVYWQTSESKTVVTYHIPQSSPLENVDSRYRNRALMSPAGMLRGDFSLRLFNVTPQDEQKFHCLVLSQSLGFQEVLSVE

SEQ ID NO: 2156 - protein, 111 aa, Artificial Sequence
  ICOSL v86  IgV
DTQEKEVRAMVGSDVELSCACPEGSRFDLNDVYVYWQPSESKTVVTYHIPQSSSLEDVDSRYRNRALMSPAGMLRGDFSLRLFNVTPQDEQKFHCLVLSQSLGFQEVLSVE

SEQ ID NO: 2157 - protein, 110 aa, Artificial Sequence
  ICOSL v87  IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSV

SEQ ID NO: 2158 - protein, 110 aa, Artificial Sequence
  ICOSL v88  IgV
DTQEKEVRAMVGSDVELSCACPEGSRFDLNDVVYWQTSESKTVVTYHIPQNSSLENVDSRYRNRALMSPAGMLRGDFSLRLFNVTPQDEQKFHCLVLSQSLGFQEVLSVE

SEQ ID NO: 2159 - protein, 111 aa, Artificial Sequence
  ICOSL v91  IgV
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSPSLGFQEVLSDE

SEQ ID NO: 2160 - protein, 238 aa, Artificial Sequence
  ICOSL v99 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2161 - protein, 238 aa, Artificial Sequence
  ICOSL v100 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2162 - protein, 238 aa, Artificial Sequence
  ICOSL v101 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 2163 - protein, 238 aa, Artificial Sequence
  ICOSL v102 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 2164 - protein, 238 aa, Artificial Sequence
  ICOSL v103 ECD
  VARIANT (207)..(207): X = N or Q
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQXLTVGSQTGNDIGERDKITENPVSTGEKNAAT

SEQ ID NO: 2165 - protein, 238 aa, Artificial Sequence
  ICOSL v104 ECD
  VARIANT (168)..(168): X = N or Q
  VARIANT (207)..(207): X = N or Q
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQXDTVFLNMRGLYDVVSVLRIARTPSVNIGCCIENVLLQQXLTVGSQTGNDIGERDKITENPVSTGEKNAAT

SEQ ID NO: 2166 - protein, 238 aa, Artificial Sequence
  ICOSL v105 ECD
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 2167 - protein, 238 aa, Artificial Sequence
  ICOSL v106 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 2168 - protein, 238 aa, Artificial Sequence
  ICOSL v107 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWIQKTDNSLLDQALQNDTVFLNMRGLYDVVSVLRIARTPSVNIGCCIENVLLQQQLTVGSQTGNDIGERDKITENPVSTGEKNAAT

SEQ ID NO: 2169 - protein, 238 aa, Artificial Sequence
  ICOSL v108 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 2170 - protein, 238 aa, Artificial Sequence
  ICOSL v109 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 2171 - protein, 238 aa, Artificial Sequence
  ICOSL v110 ECD
  VARIANT (155)..(155): X = N or Q
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIXKTDNSLLDQALQNDTVFLNMRGLYDVVSVLRIARTPSVNIGCCIENVLLQQNLTVGSQTGNDIGERDKITENPVSTGEKNAAT

SEQ ID NO: 2172 - protein, 238 aa, Artificial Sequence
  ICOSL v111 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2173 - protein, 238 aa, Artificial Sequence
  ICOSL v112 ECD
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2174 - protein, 238 aa, Artificial Sequence
  ICOSL v113 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2175 - protein, 238 aa, Artificial Sequence
  ICOSL V114 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 2176 - protein, 238 aa, Artificial Sequence
  ICOSL v115 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 2177 - protein, 238 aa, Artificial Sequence
  ICOSL v116 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIQKTDNSLLDQALQQDTVFLNMRGLYDVVSVLRIARTPSVNIGCCIENVLLQQNLTVGSQTGNDIGERDKITENPVSTGEKNAAT

SEQ ID NO: 2178 - protein, 238 aa, Artificial Sequence
  ICOSL v117 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQQLTVGSQTGNDIGERDKITENPVSTGEKNAAT

SEQ ID NO: 2179 - protein, 238 aa, Artificial Sequence
  ICOSL v118 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIHKTDNSLLDQALQNDTVFLNMRGLYDVVSVLRIARTPSVNIGCCIENVLLQQQLTVGSQTGNDIGERDKITENPVSTGEKNAAT

SEQ ID NO: 2180 - protein, 238 aa, Artificial Sequence
  ICOSL v119 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWIQKTDNSLLDQALQQDTVFLNMRGLYDVVSVLRIARTPSVNIGCCIENVLLQQQLTVGSQTGNDIGERDKITENPVSTGEKNAAT

SEQ ID NO: 2181 - protein, 238 aa, Artificial Sequence
  ICOSL v120 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIQKTDNSLLDQALQQDTVFLNMRGLYDVVSVLRIARTPSVNIGCCIENVLLQQNLTVGSQTGNDIGERDKITENPVSTGEKNAAT

SEQ ID NO: 2182 - protein, 238 aa, Artificial Sequence
  ICOSL v121 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQQDTVFLNMRGLYDVVSVLRIARTPSVNIGCCIENVLLQQQLTVGSQTGNDIGERDKITENPVSTGEKNAAT

SEQ ID NO: 2183 - protein, 238 aa, Artificial Sequence
  ICOSL v122 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 2184 - protein, 238 aa, Artificial Sequence
  ICOSL v123 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIHKTDNSLLDQALQNDTVFLNMRGLYDVVSVLRIARTPSVNIGCCIENVLLQQQLTVGSQTGNDIGERDKITENPVSTGEKNAAT

SEQ ID NO: 2185 - protein, 238 aa, Artificial Sequence
  ICOSL v124 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQNLTVGSQTGNDIGERDKITENPVSTGEKNAAT

SEQ ID NO: 2186 - protein, 238 aa, Artificial Sequence
  ICOSL v125 ECD
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQNLTVGSQTGNDIGERDKITENPVSTGEKNAAT

SEQ ID NO: 2187 - protein, 238 aa, Artificial Sequence
  ICOSL v126 ECD
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2188 - protein, 238 aa, Artificial Sequence
  ICOSL v127 ECD
  VARIANT (168)..(168): X = N or Q
  VARIANT (207)..(207): X = N or Q
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQXDTVFLNMRGLYDVVSVLRIARTPSVNIGCCIENVLLQQXLTVGSQTGNDIGERDKITENPVSTGEKNAAT

SEQ ID NO: 2189 - protein, 238 aa, Artificial Sequence
  ICOSL v128 ECD
  VARIANT (155)..(155): X = N or Q
  VARIANT (168)..(168): X = N or Q
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIXKTDNSLLDQALQXDTVFLNMRGLYDVVSVLRIARTPSVNIGCCIENVLLQQNLTVGSQTGNDIGERDKITENPVSTGEKNAAT

SEQ ID NO: 2190 - protein, 238 aa, Artificial Sequence
  ICOSL v129 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 2191 - protein, 238 aa, Artificial Sequence
  ICOSL v131 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQQDTVFLNMRGLYDVVSVLRIARTPSVNIGCCIENVLLQQNLTVGSQTGNDIGERDKITENPVSTGEKNAAT

SEQ ID NO: 2192 - protein, 238 aa, Artificial Sequence
  ICOSL v131 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIQKTDNSLLDQALQQDTVFLNMRGLYDVVSVLRIARTPSVNIGCCIENVLLQQQLTVGSQTGNDIGERDKITENPVSTGEKNAAT

SEQ ID NO: 2193 - protein, 238 aa, Artificial Sequence
  ICOSL v132 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQQLTVGSQTGNDIGERDKITENPVSTGEKNAAT

SEQ ID NO: 2194 - protein, 238 aa, Artificial Sequence
  ICOSL v133 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 2195 - protein, 238 aa, Artificial Sequence
  ICOSL v134 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQNLTVGSQTGNDIGERDKITENPVSTGEKNAAT

SEQ ID NO: 2196 - protein, 238 aa, Artificial Sequence
  ICOSL v135 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQQLTVGSQTGNDIGERDKITENPVSTGEKNAAT

SEQ ID NO: 2197 - protein, 238 aa, Artificial Sequence
  ICOSL v136 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQQDTVFLNMRGLYDVVSVLRIARTPSVNIGCCIENVLLQQQLTVGSQTGNDIGERDKITENPVSTGEKNAAT

SEQ ID NO: 2198 - protein, 111 aa, Artificial Sequence
  ICOSL v99 IgV
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVE

SEQ ID NO: 2199 - protein, 111 aa, Artificial Sequence
  ICOSL v111 IgV
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVE

SEQ ID NO: 2200 - protein, 238 aa, Artificial Sequence
  ICOSL v137 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2201 - protein, 238 aa, Artificial Sequence
  ICOSL v138 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 2202 - protein, 238 aa, Artificial Sequence
  ICOSL v139 ECD
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 2203 - protein, 238 aa, Artificial Sequence
  ICOSL v140 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2204 - protein, 238 aa, Artificial Sequence
  ICOSL v141 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 2205 - protein, 238 aa, Artificial Sequence
  ICOSL v142 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2206 - protein, 238 aa, Artificial Sequence
  ICOSL v143 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 2207 - protein, 111 aa, Artificial Sequence
  ICOSL v137 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVE

SEQ ID NO: 2208 - protein, 238 aa, Artificial Sequence
  ICOSL v144 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2209 - protein, 238 aa, Artificial Sequence
  ICOSL v145 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2210 - protein, 238 aa, Artificial Sequence
  ICOSL v146 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2211 - protein, 238 aa, Artificial Sequence
  ICOSL v147 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSVNGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2212 - protein, 238 aa, Artificial Sequence
  ICOSL v148 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2213 - protein, 238 aa, Artificial Sequence
  ICOSL v149 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSAPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2214 - protein, 238 aa, Artificial Sequence
  ICOSL v150 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVDIGCCIENVLLQQNLTVGSQTGNDIGERDKITENPVSTGEKNAAT

SEQ ID NO: 2215 - protein, 238 aa, Artificial Sequence
  ICOSL v151 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2216 - protein, 238 aa, Artificial Sequence; identical to SEQ ID NO: 2208
  ICOSL v152 ECD

SEQ ID NO: 2217 - protein, 238 aa, Artificial Sequence
  ICOSL v153 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2218 - protein, 238 aa, Artificial Sequence
  ICOSL v154 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2219 - protein, 238 aa, Artificial Sequence
  ICOSL v155 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKVTENPVSTGEKNAAT

SEQ ID NO: 2220 - protein, 238 aa, Artificial Sequence
  ICOSL v156 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 2221 - protein, 238 aa, Artificial Sequence; identical to SEQ ID NO: 2087
  ICOSL v157 ECD

SEQ ID NO: 2222 - protein, 238 aa, Artificial Sequence
  ICOSL v158 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSVPVVSAPHSPSQDELTFTCTSTNGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 2223 - protein, 238 aa, Artificial Sequence
  ICOSL v159 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 2224 - protein, 238 aa, Artificial Sequence
  ICOSL v160 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 2225 - protein, 238 aa, Artificial Sequence
  ICOSL v161 ECD
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2226 - protein, 238 aa, Artificial Sequence
  ICOSL v162 ECD
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVSLNMRGLYDVVSVLRIARTPSVNIGCRIENVLLQQNLTVGSQTGNDIGERDKITENPVSTGEKNAAT

SEQ ID NO: 2227 - protein, 238 aa, Artificial Sequence
  ICOSL v163 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2228 - protein, 238 aa, Artificial Sequence; identical to SEQ ID NO: 2227
  ICOSL v164 ECD

SEQ ID NO: 2229 - protein, 238 aa, Artificial Sequence
  ICOSL v165 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGEIDKITENPVSTGEKNAAT

SEQ ID NO: 2230 - protein, 238 aa, Artificial Sequence
  ICOSL v166 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2231 - protein, 238 aa, Artificial Sequence
  ICOSL v167 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVSLNMRGLYDVVSVLRIARTPSVDIGCCIENVLLQQNLTVGSQTGNDIGERDKITENPVSTGEKNAAT

SEQ ID NO: 2232 - protein, 238 aa, Artificial Sequence
  ICOSL v168 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANSSVPVVSAPHSPSQDELTFTCTSVNGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2233 - protein, 238 aa, Artificial Sequence
  ICOSL v169 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2234 - protein, 238 aa, Artificial Sequence
  ICOSL v170 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2235 - protein, 238 aa, Artificial Sequence
  ICOSL v171 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2236 - protein, 238 aa, Artificial Sequence
  ICOSL v172 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2237 - protein, 238 aa, Artificial Sequence
  ICOSL v173 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2238 - protein, 238 aa, Artificial Sequence
  ICOSL v174 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2239 - protein, 238 aa, Artificial Sequence
  ICOSL v175 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 2240 - protein, 238 aa, Artificial Sequence
  ICOSL v176 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 2241 - protein, 238 aa, Artificial Sequence
  ICOSL v177 ECD
  VARIANT (115)..(115): X is H or Q
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLXVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2242 - protein, 238 aa, Artificial Sequence
  ICOSL v178 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 2243 - protein, 238 aa, Artificial Sequence; identical to SEQ ID NO: 2209
  ICOSL v179 ECD

SEQ ID NO: 2244 - protein, 122 aa, Homo sapiens
  MISC_FEATURE: ICOSL WT IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSV

SEQ ID NO: 2245 - protein, 122 aa, Artificial Sequence
  ICOSL v1 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSV

SEQ ID NO: 2246 - protein, 122 aa, Artificial Sequence
  ICOSL v2 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSV

SEQ ID NO: 2247 - protein, 122 aa, Artificial Sequence
  ICOSL v3 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSV

SEQ ID NO: 2248 - protein, 122 aa, Artificial Sequence
  ICOSL v5 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSV

SEQ ID NO: 2249 - protein, 122 aa, Artificial Sequence
  ICOSL v10 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVEVTLHVAANFSV

SEQ ID NO: 2250 - protein, 122 aa, Artificial Sequence
  ICOSL v11 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVEVTLHVAANFSV

SEQ ID NO: 2251 - protein, 122 aa, Artificial Sequence
  ICOSL v12 IgV
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVEVTLHVAANFSV

SEQ ID NO: 2252 - protein, 122 aa, Artificial Sequence
  ICOSL v13 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVEVTLHVAANFSV

SEQ ID NO: 2253 - protein, 122 aa, Artificial Sequence
  ICOSL v14 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVEVTLHVAANFSV

SEQ ID NO: 2254 - protein, 122 aa, Artificial Sequence
  ICOSL v21 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVELHVAANFSV

SEQ ID NO: 2255 - protein, 122 aa, Artificial Sequence
  ICOSL v22 IgV
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVEVTLHVAANFSV

SEQ ID NO: 2256 - protein, 122 aa, Artificial Sequence
  ICOSL v23 IgV
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVEVTLHVAANFSV

SEQ ID NO: 2257 - protein, 122 aa, Artificial Sequence
  ICOSL v28 IgV
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVEVTLHVAANFSV

SEQ ID NO: 2258 - protein, 122 aa, Artificial Sequence
  ICOSL v33 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVEVTLHVAANFSV

SEQ ID NO: 2259 - protein, 122 aa, Artificial Sequence
  ICOSL v34 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVEVTLHVAANSSV

SEQ ID NO: 2260 - protein, 122 aa, Artificial Sequence
  ICOSL v35 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVEVTLHVAANFSV

SEQ ID NO: 2261 - protein, 122 aa, Artificial Sequence
  ICOSL v36 IgV
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVEVTLHVAANFSV

SEQ ID NO: 2262 - protein, 122 aa, Artificial Sequence
  ICOSL v37 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSV

SEQ ID NO: 2263 - protein, 122 aa, Artificial Sequence
  ICOSL v38 IgV
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSRSLGFQEVLSDEVTLHVAANFSV

SEQ ID NO: 2264 - protein, 122 aa, Artificial Sequence
  ICOSL v39 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSV

SEQ ID NO: 2265 - protein, 122 aa, Artificial Sequence
  ICOSL v40 IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSRSLGFQEVLSDEVTLHVAANFSV

SEQ ID NO: 2266 - protein, 122 aa, Artificial Sequence
  ICOSL v41 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSV

SEQ ID NO: 2267 - protein, 122 aa, Artificial Sequence
  ICOSL v42 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFGV

SEQ ID NO: 2268 - protein, 122 aa, Artificial Sequence
  ICOSL v43 IgV
DTQEKEVRAMVGSDVELSCVCPEGSRFDLNDVYVYWQTSESKTVVTYHIPQHSSLEYVDSRYRNRALMSPAGMLRGDFSLRLFNVTPQDEQKFHCLVLSRSLGFQEVLGVEVTLHVAANFSV

SEQ ID NO: 2269 - protein, 122 aa, Artificial Sequence; identical to SEQ ID NO: 2248
  ICOSL v44 IgV

SEQ ID NO: 2270 - protein, 122 aa, Artificial Sequence
  ICOSL v46 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSA

SEQ ID NO: 2271 - protein, 122 aa, Artificial Sequence
  ICOSL v48 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLHVAANFSV

SEQ ID NO: 2272 - protein, 122 aa, Artificial Sequence
  ICOSL v49 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSV

SEQ ID NO: 2273 - protein, 122 aa, Artificial Sequence
  ICOSL v50 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLALSQSLGFQEVLSVEVTLHVAANFSV

SEQ ID NO: 2274 - protein, 122 aa, Artificial Sequence
  ICOSL v51 IgV
DTQEKEVRAMVGSDVELSCACPEGSRFDLNDVYVYWQTSESKTVVTYHIPQSSSLENVDSRYRNRALMSPARMLRGDFSLRLFNVTPQDEQKFHCLVLSQSLGFQEVLSVEVTLHVAANFSV

SEQ ID NO: 2275 - protein, 122 aa, Artificial Sequence
  ICOSL v52 IgV
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVEVTLHVTANFSV

SEQ ID NO: 2276 - protein, 122 aa, Artificial Sequence
  ICOSL v54 IgV
DTQEKEVRAMVGSDVELSCACPEGSRFDLNDVYVYWQTSESKTVVTHHIPQSSSLENVDSRYRNRALMSPAGMLRGDFSLRLFNVTPQDEQKFHCLVLSQSLGFQEALSVEVTLHVAANSSV

SEQ ID NO: 2277 - protein, 122 aa, Artificial Sequence
  ICOSL v60 IgV
DTQEKEVRAMVGSDVELSCACPEGSRSDLNDVYVYWQTSESKTVVTYHIPQHSSLEYVDSRYRNRALMSPAGMLRGDFSLRLFNVTPQDEQKFHCLVLSQSLGFQEVLSNEVTLHVAANFSV

SEQ ID NO: 2278 - protein, 122 aa, Artificial Sequence
  ICOSL v65 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLSVEVTLHVAANFSM

SEQ ID NO: 2279 - protein, 122 aa, Artificial Sequence
  ICOSL v78 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECLVFSRSLGFQEVLSVEVTLHVAANFSV

SEQ ID NO: 2280 - protein, 122 aa, Artificial Sequence
  ICOSL v79 IgV
DTQEKEVRAMVGSDVELSCACPEGSRFDLNDVYVYWQTSESKTVVTYHIPQSSSLENVDSRYRNRALMSPAGMLRGDFSLRLFNVTPQDAQKFHCLVLSQSLGFQEVLSVEVTLHVAANFSV

SEQ ID NO: 2281 - protein, 122 aa, Artificial Sequence
  ICOSL v80 IgV
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLHVAANFSV

SEQ ID NO: 2282 - protein, 122 aa, Artificial Sequence
  ICOSL v85 IgV
DTQEKEVRAMVGSDVELSCACPEGSRFDLNDVYVYWQTSESKTVVTYHIPQSSPLENVDSRYRNRALMSPAGMLRGDFSLRLFNVTPQDEQKFHCLVLSQSLGFQEVLSVEVTLHVAANFSV

SEQ ID NO: 2283 - protein, 122 aa, Artificial Sequence
  ICOSL v86 IgV
DTQEKEVRAMVGSDVELSCACPEGSRFDLNDVYVYWQPSESKTVVTYHIPQSSSLEDVDSRYRNRALMSPAGMLRGDFSLRLFNVTPQDEQKFHCLVLSQSLGFQEVLSVEVTLHVAANFSV

SEQ ID NO: 2284 - protein, 121 aa, Artificial Sequence
  ICOSL v87 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVVTLHVAANFSV

SEQ ID NO: 2285 - protein, 121 aa, Artificial Sequence
  ICOSL v88 IgV
DTQEKEVRAMVGSDVELSCACPEGSRFDLNDVVYWQTSESKTVVTYHIPQNSSLENVDSRYRNRALMSPAGMLRGDFSLRLFNVTPQDEQKFHCLVLSQSLGFQEVLSVEVTLHVAANFSV

SEQ ID NO: 2286 - protein, 122 aa, Artificial Sequence
  ICOSL v91  IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSQSLGFQEVLSDEVTLHVAANFSV

SEQ ID NO: 2287 - protein, 122 aa, Artificial Sequence
  ICOSL v99 IgV
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSV

SEQ ID NO: 2288 - protein, 122 aa, Artificial Sequence
  ICOSL v100 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSV

SEQ ID NO: 2289 - protein, 122 aa, Artificial Sequence
  ICOSL v111 IgV
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSV

SEQ ID NO: 2290 - protein, 122 aa, Artificial Sequence
  ICOSL v112 IgV
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAAQFSV

SEQ ID NO: 2291 - protein, 122 aa, Artificial Sequence
  ICOSL v113 IgV
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSV

SEQ ID NO: 2292 - protein, 122 aa, Artificial Sequence
  ICOSL v126 IgV
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAAQFSV

SEQ ID NO: 2293 - protein, 122 aa, Artificial Sequence
  ICOSL v137 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVEVTLHVAANFSV

SEQ ID NO: 2294 - protein, 122 aa, Artificial Sequence
  ICOSL v153 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLRVAANFSV

SEQ ID NO: 2295 - protein, 122 aa, Artificial Sequence
  ICOSL v154 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSV

SEQ ID NO: 2296 - protein, 122 aa, Artificial Sequence
  ICOSL v163 IgV
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSV

SEQ ID NO: 2297 - protein, 122 aa, Artificial Sequence; identical to SEQ ID NO: 2296
  ICOSL v164 IgV

SEQ ID NO: 2298 - protein, 122 aa, Artificial Sequence
  ICOSL v173 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSV

SEQ ID NO: 2299 - protein, 238 aa, Artificial Sequence
  ICOSL v180 ECD
DTQEKEVRAMVGSDVELSCACPEGSRFDLNDVYVYWQTSESKTVVTYHIPQASSLEFVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2300 - protein, 238 aa, Artificial Sequence
  ICOSL v181 ECD
DTQEKEVRAMVGSDVELSCACPEGSRFDLNDVYVYWQTSESKTVVTYHIPQASSLEHVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2301 - protein, 238 aa, Artificial Sequence
  ICOSL v182 ECD
DTQEKEVRAMVGSDVELSCACPEGSRFDLNDVYVYWQTSESKTVVTYHIPQASSLEYVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2302 - protein, 238 aa, Artificial Sequence
  ICOSL v183 ECD
DTQEKEVRAMVGSDVELSCACPEGSRFDLNDVYVYWQTSESKTVVTYHIPQDSSLEAVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2303 - protein, 238 aa, Artificial Sequence
  ICOSL v184 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2304 - protein, 238 aa, Artificial Sequence
  ICOSL v185 ECD
DTQEKEVRAMVGSDVELSCACPEGSRFDLNDVYVYWQTSESKTVVTYHIPQGSSLENVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2305 - protein, 238 aa, Artificial Sequence
  ICOSL v186 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2306 - protein, 238 aa, Artificial Sequence
  ICOSL v187 ECD
DTQEKEVRAMVGSDVELSCACPEGSRFDLNDVYVYWQTSESKTVVTYHIPQMSSLEHVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2307 - protein, 238 aa, Artificial Sequence
  ICOSL v188 ECD
DTQEKEVRAMVGSDVELSCACPEGSRFDLNDVYVYWQTSESKTVVTYHIPQMSSLEWVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2308 - protein, 238 aa, Artificial Sequence
  ICOSL v189 ECD
DTQEKEVRAMVGSDVELSCACPEGSRFDLNDVYVYWQTSESKTVVTYHIPQQSSLEFVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2309 - protein, 238 aa, Artificial Sequence
  ICOSL v190 ECD
DTQEKEVRAMVGSDVELSCACPEGSRFDLNDVYVYWQTSESKTVVTYHIPQQSSLESVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2310 - protein, 238 aa, Artificial Sequence
  ICOSL v191 ECD
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2311 - protein, 238 aa, Artificial Sequence
  ICOSL v192 ECD
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2312 - protein, 238 aa, Artificial Sequence
  ICOSL v193 ECD
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2313 - protein, 238 aa, Artificial Sequence
  ICOSL v194 ECD
DTQEKEVRAMVGSDVELSCACPEGSRFDLNDVYVYWQTSESKTVVTYHIPQSSSLEAVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2314 - protein, 238 aa, Artificial Sequence
  ICOSL v195 ECD
DTQEKEVRAMVGSDVELSCACPEGSRFDLNDVYVYWQTSESKTVVTYHIPQSSSLEHVDSRYRNRALMSPAGMLRGDFSLRLFNVTPQDEQKFHCLVLSESLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2315 - protein, 238 aa, Artificial Sequence
  ICOSL v196 ECD
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2316 - protein, 238 aa, Artificial Sequence
  ICOSL v197 ECD
DTQEKEVRAMVGSDVELSCACPEGSRFDLNDVYVYWQTSESKTVVTYHIPQSSSLEMVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2317 - protein, 238 aa, Artificial Sequence
  ICOSL v198 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2318 - protein, 238 aa, Artificial Sequence
  ICOSL v199 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSMSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2319 - protein, 238 aa, Artificial Sequence
  ICOSL v200 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSVSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2320 - protein, 238 aa, Artificial Sequence
  ICOSL v201 ECD
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2321 - protein, 238 aa, Artificial Sequence
  ICOSL v202 ECD
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2322 - protein, 238 aa, Artificial Sequence
  ICOSL v203 ECD
DTQEKEVRAMVGSDVELSCACPEGSRFDLNDVYVYWQTSESKTVVTYHIPQTSSLEYVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2323 - protein, 238 aa, Artificial Sequence
  ICOSL v204 ECD
DTQEKEVRAMVGSDVELSCACPEGSRFDLNDVYVYWQTSESKTVVTYHIPQVSSLELVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2324 - protein, 238 aa, Artificial Sequence
  ICOSL v205 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2325 - protein, 238 aa, Artificial Sequence
  ICOSL v206 ECD
DTQEKEVRAMVGSDVELSCACPEGSRFDLNDVYVYWQTSESKTVVTYHIPQKSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2326 - protein, 238 aa, Artificial Sequence
  ICOSL v207 ECD
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2327 - protein, 238 aa, Artificial Sequence
  ICOSL v208 ECD
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSNSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2328 - protein, 238 aa, Artificial Sequence
  ICOSL v209 ECD
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2329 - protein, 238 aa, Artificial Sequence
  ICOSL V210 ECD
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2330 - protein, 238 aa, Artificial Sequence
  ICOSL v211 ECD
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSTSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2331 - protein, 238 aa, Artificial Sequence
  ICOSL v212 ECD
DTQEKEVRAMVGSDVELSCACPEGSRFDLNDVYVYWQTSESKTVVTYHIPQRSSLEHVDSRYRNRALMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2332 - protein, 238 aa, Artificial Sequence
  ICOSL v213 ECD
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2333 - protein, 238 aa, Artificial Sequence
  ICOSL v214 ECD
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2334 - protein, 238 aa, Artificial Sequence
  ICOSL v215 ECD
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2335 - protein, 238 aa, Artificial Sequence
  ICOSL v216 ECD
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2336 - protein, 238 aa, Artificial Sequence
  ICOSL v217 ECD
DTQEKEVRAMVGSDVELSCACPEGSRFDLNDVYVYWQTSESKTVVTYHIPQCSSLEEVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2337 - protein, 238 aa, Artificial Sequence
  ICOSL v218 ECD
DTQEKEVRAMVGSDVELSCACPEGSRFDLNDVYVYWQTSESKTVVTYHIPQGSSLEPVDSRYRNRALMSPAGMLRGDFSLRLFNVTPQDEQKFHCLVLSDSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2338 - protein, 238 aa, Artificial Sequence
  ICOSL v219 ECD
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSGSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2339 - protein, 238 aa, Artificial Sequence
  ICOSL v220 ECD
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2340 - protein, 238 aa, Artificial Sequence
  ICOSL v221 ECD
DTQEKEVRAMVGSDVELSCACPEGSRFDLNDVYVYWQTSESKTVVTYHIPQLSSLEVVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2341 - protein, 238 aa, Artificial Sequence
  ICOSL v222 ECD
DTQEKEVRAMVGSDVELSCACPEGSRFDLNDVYVYWQTSESKTVVTYHIPQPSSLEPVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2342 - protein, 238 aa, Artificial Sequence
  ICOSL v223 ECD
DTQEKEVRAMVGSDVELSCACPEGSRFDLNDVYVYWQTSESKTVVTYHIPQPSSLESVDSRYRNRALMSPAGMLRGDFSLRLFNVTPQDEQKFHCLVLSGSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2343 - protein, 238 aa, Artificial Sequence
  ICOSL v224 ECD
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSGSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2344 - protein, 238 aa, Artificial Sequence
  ICOSL v225 ECD
DTQEKEVRAMVGSDVELSCACPEGSRFDLNDVYVYWQTSESKTVVTYHIPQTSSLEKVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2345 - protein, 238 aa, Artificial Sequence
  ICOSL v226 ECD
DTQEKEVRAMVGSDVELSCACPEGSRFDLNDVYVYWQTSESKTVVTYHIPQVSSLETVDSRYRNRALMSPAGMLRGDFSLRLFNVTPQDEQKFHCLVLSLSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2346 - protein, 238 aa, Artificial Sequence
  ICOSL v227 ECD
DTQEKEVRAMVGSDVELSCACPEGSRFDLNDVYVYWQTSESKTVVTYHIPQNSSLEQVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 2347 - protein, 111 aa, Artificial Sequence
  ICOSL v180 IgV
DTQEKEVRAMVGSDVELSCACPEGSRFDLNDVYVYWQTSESKTVVTYHIPQASSLEFVDSRYRNRALMSPAGMLRGDFSLRLFNVTPQDEQKFHCLVLSSSLGFQEVLSVE

SEQ ID NO: 2348 - protein, 111 aa, Artificial Sequence
  ICOSL v181 IgV
DTQEKEVRAMVGSDVELSCACPEGSRFDLNDVYVYWQTSESKTVVTYHIPQASSLEHVDSRYRNRALMSPAGMLRGDFSLRLFNVTPQDEQKFHCLVLSSSLGFQEVLSVE

SEQ ID NO: 2349 - protein, 111 aa, Artificial Sequence
  ICOSL v182 IgV
DTQEKEVRAMVGSDVELSCACPEGSRFDLNDVYVYWQTSESKTVVTYHIPQASSLEYVDSRYRNRALMSPAGMLRGDFSLRLFNVTPQDEQKFHCLVLSASLGFQEVLSVE

SEQ ID NO: 2350 - protein, 111 aa, Artificial Sequence
  ICOSL v183 IgV
DTQEKEVRAMVGSDVELSCACPEGSRFDLNDVYVYWQTSESKTVVTYHIPQDSSLEAVDSRYRNRALMSPAGMLRGDFSLRLFNVTPQDEQKFHCLVLSASLGFQEVLSVE

SEQ ID NO: 2351 - protein, 111 aa, Artificial Sequence
  ICOSL v184 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSSSLGFQEVLSVE

SEQ ID NO: 2352 - protein, 111 aa, Artificial Sequence
  ICOSL v185 IgV
DTQEKEVRAMVGSDVELSCACPEGSRFDLNDVYVYWQTSESKTVVTYHIPQGSSLENVDSRYRNRALMSPAGMLRGDFSLRLFNVTPQDEQKFHCLVLSASLGFQEVLSVE

SEQ ID NO: 2353 - protein, 111 aa, Artificial Sequence
  ICOSL v186 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSASLGFQEVLSVE

SEQ ID NO: 2354 - protein, 111 aa, Artificial Sequence
  ICOSL v187 IgV
DTQEKEVRAMVGSDVELSCACPEGSRFDLNDVYVYWQTSESKTVVTYHIPQMSSLEHVDSRYRNRALMSPAGMLRGDFSLRLFNVTPQDEQKFHCLVLSSSLGFQEVLSVE

SEQ ID NO: 2355 - protein, 111 aa, Artificial Sequence
  ICOSL v188 IgV
DTQEKEVRAMVGSDVELSCACPEGSRFDLNDVYVYWQTSESKTVVTYHIPQMSSLEWVDSRYRNRALMSPAGMLRGDFSLRLFNVTPQDEQKFHCLVLSPSLGFQEVLSVE

SEQ ID NO: 2356 - protein, 111 aa, Artificial Sequence
  ICOSL v189 IgV
DTQEKEVRAMVGSDVELSCACPEGSRFDLNDVYVYWQTSESKTVVTYHIPQQSSLEFVDSRYRNRALMSPAGMLRGDFSLRLFNVTPQDEQKFHCLVLSQSLGFQEVLSVE

SEQ ID NO: 2357 - protein, 111 aa, Artificial Sequence
  ICOSL v190 IgV
DTQEKEVRAMVGSDVELSCACPEGSRFDLNDVYVYWQTSESKTVVTYHIPQQSSLESVDSRYRNRALMSPAGMLRGDFSLRLFNVTPQDEQKFHCLVLSASLGFQEVLSVE

SEQ ID NO: 2358 - protein, 111 aa, Artificial Sequence
  ICOSL v191 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSASLGFQEVLSVE

SEQ ID NO: 2359 - protein, 111 aa, Artificial Sequence
  ICOSL v192 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSPSLGFQEVLSVE

SEQ ID NO: 2360 - protein, 111 aa, Artificial Sequence
  ICOSL v193 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSSSLGFQEVLSVE

SEQ ID NO: 2361 - protein, 111 aa, Artificial Sequence
  ICOSL v194 IgV
DTQEKEVRAMVGSDVELSCACPEGSRFDLNDVYVYWQTSESKTVVTYHIPQSSSLEAVDSRYRNRALMSPAGMLRGDFSLRLFNVTPQDEQKFHCLVLSASLGFQEVLSVE

SEQ ID NO: 2362 - protein, 111 aa, Artificial Sequence
  ICOSL v195 IgV
DTQEKEVRAMVGSDVELSCACPEGSRFDLNDVYVYWQTSESKTVVTYHIPQSSSLEHVDSRYRNRALMSPAGMLRGDFSLRLFNVTPQDEQKFHCLVLSESLGFQEVLSVE

SEQ ID NO: 2363 - protein, 111 aa, Artificial Sequence
  ICOSL v196 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSSSLGFQEVLSVE

SEQ ID NO: 2364 - protein, 111 aa, Artificial Sequence
  ICOSL v197 IgV
DTQEKEVRAMVGSDVELSCACPEGSRFDLNDVYVYWQTSESKTVVTYHIPQSSSLEMVDSRYRNRALMSPAGMLRGDFSLRLFNVTPQDEQKFHCLVLSSSLGFQEVLSVE

SEQ ID NO: 2365 - protein, 111 aa, Artificial Sequence
  ICOSL v198 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSSSLGFQEVLSVE

SEQ ID NO: 2366 - protein, 111 aa, Artificial Sequence
  ICOSL v199 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSMSLGFQEVLSVE

SEQ ID NO: 2367 - protein, 111 aa, Artificial Sequence
  ICOSL v200 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSVSLGFQEVLSVE

SEQ ID NO: 2368 - protein, 111 aa, Artificial Sequence
  ICOSL v201 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSSSLGFQEVLSVE

SEQ ID NO: 2369 - protein, 111 aa, Artificial Sequence
  ICOSL v202 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSASLGFQEVLSVE

SEQ ID NO: 2370 - protein, 111 aa, Artificial Sequence
  ICOSL v203 IgV
DTQEKEVRAMVGSDVELSCACPEGSRFDLNDVYVYWQTSESKTVVTYHIPQTSSLEYVDSRYRNRALMSPAGMLRGDFSLRLFNVTPQDEQKFHCLVLSASLGFQEVLSVE

SEQ ID NO: 2371 - protein, 111 aa, Artificial Sequence
  ICOSL v204 IgV
DTQEKEVRAMVGSDVELSCACPEGSRFDLNDVYVYWQTSESKTVVTYHIPQVSSLELVDSRYRNRALMSPAGMLRGDFSLRLFNVTPQDEQKFHCLVLSASLGFQEVLSVE

SEQ ID NO: 2372 - protein, 111 aa, Artificial Sequence
  ICOSL v205 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSKSLGFQEVLSVE

SEQ ID NO: 2373 - protein, 111 aa, Artificial Sequence
  ICOSL v206 IgV
DTQEKEVRAMVGSDVELSCACPEGSRFDLNDVYVYWQTSESKTVVTYHIPQKSSLEYVDSRYRNRALMSPAGMLRGDFSLRLFNVTPQDEQKFHCLVLSRSLGFQEVLSVE

SEQ ID NO: 2374 - protein, 111 aa, Artificial Sequence
  ICOSL v207 IgV
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVE

SEQ ID NO: 2375 - protein, 111 aa, Artificial Sequence
  ICOSL v208 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSNSLGFQEVLSVE

SEQ ID NO: 2376 - protein, 111 aa, Artificial Sequence
  ICOSL v209 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSPSLGFQEVLSVE

SEQ ID NO: 2377 - protein, 111 aa, Artificial Sequence
  ICOSL v210 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSRSLGFQEVLSVE

SEQ ID NO: 2378 - protein, 111 aa, Artificial Sequence
  ICOSL v211 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSTSLGFQEVLSVE

SEQ ID NO: 2379 - protein, 111 aa, Artificial Sequence
  ICOSL v212 IgV
DTQEKEVRAMVGSDVELSCACPEGSRFDLNDVYVYWQTSESKTVVTYHIPQRSSLEHVDSRYRNRALMSPAGMLRGDFSLRLFNVTPQDEQKFHCLVLSKSLGFQEVLSVE

SEQ ID NO: 2380 - protein, 111 aa, Artificial Sequence
  ICOSL v213 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSSSLGFQEVLSVE

SEQ ID NO: 2381 - protein, 111 aa, Artificial Sequence
  ICOSL v214 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSKSLGFQEVLSVE

SEQ ID NO: 2382 - protein, 111 aa, Artificial Sequence
  ICOSL v215 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSQSLGFQEVLSVE

SEQ ID NO: 2383 - protein, 111 aa, Artificial Sequence
  ICOSL v216 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSRSLGFQEVLSVE

SEQ ID NO: 2384 - protein, 111 aa, Artificial Sequence
  ICOSL v217 IgV
DTQEKEVRAMVGSDVELSCACPEGSRFDLNDVYVYWQTSESKTVVTYHIPQCSSLEEVDSRYRNRALMSPAGMLRGDFSLRLFNVTPQDEQKFHCLVLSSSLGFQEVLSVE

SEQ ID NO: 2385 - protein, 111 aa, Artificial Sequence
  ICOSL v218 IgV
DTQEKEVRAMVGSDVELSCACPEGSRFDLNDVYVYWQTSESKTVVTYHIPQGSSLEPVDSRYRNRALMSPAGMLRGDFSLRLFNVTPQDEQKFHCLVLSDSLGFQEVLSVE

SEQ ID NO: 2386 - protein, 111 aa, Artificial Sequence
  ICOSL v219 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSGSLGFQEVLSVE

SEQ ID NO: 2387 - protein, 111 aa, Artificial Sequence
  ICOSL v220 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSQSLGFQEVLSVE

SEQ ID NO: 2388 - protein, 111 aa, Artificial Sequence
  ICOSL v221 IgV
DTQEKEVRAMVGSDVELSCACPEGSRFDLNDVYVYWQTSESKTVVTYHIPQLSSLEVVDSRYRNRALMSPAGMLRGDFSLRLFNVTPQDEQKFHCLVLSQSLGFQEVLSVE

SEQ ID NO: 2389 - protein, 111 aa, Artificial Sequence
  ICOSL v222 IgV
DTQEKEVRAMVGSDVELSCACPEGSRFDLNDVYVYWQTSESKTVVTYHIPQPSSLEPVDSRYRNRALMSPAGMLRGDFSLRLFNVTPQDEQKFHCLVLSQSLGFQEVLSVE

SEQ ID NO: 2390 - protein, 111 aa, Artificial Sequence
  ICOSL v223 IgV
DTQEKEVRAMVGSDVELSCACPEGSRFDLNDVYVYWQTSESKTVVTYHIPQPSSLESVDSRYRNRALMSPAGMLRGDFSLRLFNVTPQDEQKFHCLVLSGSLGFQEVLSVE

SEQ ID NO: 2391 - protein, 111 aa, Artificial Sequence
  ICOSL v224 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSGSLGFQEVLSVE

SEQ ID NO: 2392 - protein, 111 aa, Artificial Sequence
  ICOSL v225 IgV
DTQEKEVRAMVGSDVELSCACPEGSRFDLNDVYVYWQTSESKTVVTYHIPQTSSLEKVDSRYRNRALMSPAGMLRGDFSLRLFNVTPQDEQKFHCLVLSPSLGFQEVLSVE

SEQ ID NO: 2393 - protein, 111 aa, Artificial Sequence
  ICOSL v226 IgV
DTQEKEVRAMVGSDVELSCACPEGSRFDLNDVYVYWQTSESKTVVTYHIPQVSSLETVDSRYRNRALMSPAGMLRGDFSLRLFNVTPQDEQKFHCLVLSLSLGFQEVLSVE

SEQ ID NO: 2394 - protein, 111 aa, Artificial Sequence
  ICOSL v227 IgV
DTQEKEVRAMVGSDVELSCACPEGSRFDLNDVYVYWQTSESKTVVTYHIPQNSSLEQVDSRYRNRALMSPAGMLRGDFSLRLFNVTPQDEQKFHCLVLSPSLGFQEVLSVE

SEQ ID NO: 2395 - protein, 122 aa, Artificial Sequence
  ICOSL v180 IgV
DTQEKEVRAMVGSDVELSCACPEGSRFDLNDVYVYWQTSESKTVVTYHIPQASSLEFVDSRYRNRALMSPAGMLRGDFSLRLFNVTPQDEQKFHCLVLSSSLGFQEVLSVEVTLHVAANFSV

SEQ ID NO: 2396 - protein, 122 aa, Artificial Sequence
  ICOSL v181 IgV
DTQEKEVRAMVGSDVELSCACPEGSRFDLNDVYVYWQTSESKTVVTYHIPQASSLEHVDSRYRNRALMSPAGMLRGDFSLRLFNVTPQDEQKFHCLVLSSSLGFQEVLSVEVTLHVAANFSV

SEQ ID NO: 2397 - protein, 122 aa, Artificial Sequence
  ICOSL v182 IgV
DTQEKEVRAMVGSDVELSCACPEGSRFDLNDVYVYWQTSESKTVVTYHIPQASSLEYVDSRYRNRALMSPAGMLRGDFSLRLFNVTPQDEQKFHCLVLSASLGFQEVLSVEVTLHVAANFSV

SEQ ID NO: 2398 - protein, 122 aa, Artificial Sequence
  ICOSL v183 IgV
DTQEKEVRAMVGSDVELSCACPEGSRFDLNDVYVYWQTSESKTVVTYHIPQDSSLEAVDSRYRNRALMSPAGMLRGDFSLRLFNVTPQDEQKFHCLVLSASLGFQEVLSVEVTLHVAANFSV

SEQ ID NO: 2399 - protein, 122 aa, Artificial Sequence
  ICOSL v184 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSSSLGFQEVLSVEVTLHVAANFSV

SEQ ID NO: 2400 - protein, 122 aa, Artificial Sequence
  ICOSL v185 IgV
DTQEKEVRAMVGSDVELSCACPEGSRFDLNDVYVYWQTSESKTVVTYHIPQGSSLENVDSRYRNRALMSPAGMLRGDFSLRLFNVTPQDEQKFHCLVLSASLGFQEVLSVEVTLHVAANFSV

SEQ ID NO: 2401 - protein, 122 aa, Artificial Sequence
  ICOSL v186 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSASLGFQEVLSVEVTLHVAANFSV

SEQ ID NO: 2402 - protein, 122 aa, Artificial Sequence
  ICOSL v187 IgV
DTQEKEVRAMVGSDVELSCACPEGSRFDLNDVYVYWQTSESKTVVTYHIPQMSSLEHVDSRYRNRALMSPAGMLRGDFSLRLFNVTPQDEQKFHCLVLSSSLGFQEVLSVEVTLHVAANFSV

SEQ ID NO: 2403 - protein, 122 aa, Artificial Sequence
  ICOSL v188 IgV
DTQEKEVRAMVGSDVELSCACPEGSRFDLNDVYVYWQTSESKTVVTYHIPQMSSLEWVDSRYRNRALMSPAGMLRGDFSLRLFNVTPQDEQKFHCLVLSPSLGFQEVLSVEVTLHVAANFSV

SEQ ID NO: 2404 - protein, 122 aa, Artificial Sequence
  ICOSL v189 IgV
DTQEKEVRAMVGSDVELSCACPEGSRFDLNDVYVYWQTSESKTVVTYHIPQQSSLEFVDSRYRNRALMSPAGMLRGDFSLRLFNVTPQDEQKFHCLVLSQSLGFQEVLSVEVTLHVAANFSV

SEQ ID NO: 2405 - protein, 122 aa, Artificial Sequence
  ICOSL v190 IgV
DTQEKEVRAMVGSDVELSCACPEGSRFDLNDVYVYWQTSESKTVVTYHIPQQSSLESVDSRYRNRALMSPAGMLRGDFSLRLFNVTPQDEQKFHCLVLSASLGFQEVLSVEVTLHVAANFSV

SEQ ID NO: 2406 - protein, 122 aa, Artificial Sequence
  ICOSL v191 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSASLGFQEVLSVEVTLHVAANFSV

SEQ ID NO: 2407 - protein, 122 aa, Artificial Sequence
  ICOSL v192 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSPSLGFQEVLSVEVTLHVAANFSV

SEQ ID NO: 2408 - protein, 122 aa, Artificial Sequence
  ICOSL v193 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSSSLGFQEVLSVEVTLHVAANFSV

SEQ ID NO: 2409 - protein, 122 aa, Artificial Sequence
  ICOSL v194 IgV
DTQEKEVRAMVGSDVELSCACPEGSRFDLNDVYVYWQTSESKTVVTYHIPQSSSLEAVDSRYRNRALMSPAGMLRGDFSLRLFNVTPQDEQKFHCLVLSASLGFQEVLSVEVTLHVAANFSV

SEQ ID NO: 2410 - protein, 122 aa, Artificial Sequence
  ICOSL v195 IgV
DTQEKEVRAMVGSDVELSCACPEGSRFDLNDVYVYWQTSESKTVVTYHIPQSSSLEHVDSRYRNRALMSPAGMLRGDFSLRLFNVTPQDEQKFHCLVLSESLGFQEVLSVEVTLHVAANFSV

SEQ ID NO: 2411 - protein, 122 aa, Artificial Sequence
  ICOSL v196 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSSSLGFQEVLSVEVTLHVAANFSV

SEQ ID NO: 2412 - protein, 122 aa, Artificial Sequence
  ICOSL v197 IgV
DTQEKEVRAMVGSDVELSCACPEGSRFDLNDVYVYWQTSESKTVVTYHIPQSSSLEMVDSRYRNRALMSPAGMLRGDFSLRLFNVTPQDEQKFHCLVLSSSLGFQEVLSVEVTLHVAANFSV

SEQ ID NO: 2413 - protein, 122 aa, Artificial Sequence
  ICOSL v198 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSSSLGFQEVLSVEVTLHVAANFSV

SEQ ID NO: 2414 - protein, 122 aa, Artificial Sequence
  ICOSL v199 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSMSLGFQEVLSVEVTLHVAANFSV

SEQ ID NO: 2415 - protein, 122 aa, Artificial Sequence
  ICOSL v200 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSVSLGFQEVLSVEVTLHVAANFSV

SEQ ID NO: 2416 - protein, 122 aa, Artificial Sequence
  ICOSL v201 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSSSLGFQEVLSVEVTLHVAANFSV

SEQ ID NO: 2417 - protein, 122 aa, Artificial Sequence
  ICOSL v202 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSASLGFQEVLSVEVTLHVAANFSV

SEQ ID NO: 2418 - protein, 122 aa, Artificial Sequence
  ICOSL v203 IgV
DTQEKEVRAMVGSDVELSCACPEGSRFDLNDVYVYWQTSESKTVVTYHIPQTSSLEYVDSRYRNRALMSPAGMLRGDFSLRLFNVTPQDEQKFHCLVLSASLGFQEVLSVEVTLHVAANFSV

SEQ ID NO: 2419 - protein, 122 aa, Artificial Sequence
  ICOSL v204 IgV
DTQEKEVRAMVGSDVELSCACPEGSRFDLNDVYVYWQTSESKTVVTYHIPQVSSLELVDSRYRNRALMSPAGMLRGDFSLRLFNVTPQDEQKFHCLVLSASLGFQEVLSVEVTLHVAANFSV

SEQ ID NO: 2420 - protein, 122 aa, Artificial Sequence
  ICOSL v205 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSKSLGFQEVLSVEVTLHVAANFSV

SEQ ID NO: 2421 - protein, 122 aa, Artificial Sequence
  ICOSL v206 IgV
DTQEKEVRAMVGSDVELSCACPEGSRFDLNDVYVYWQTSESKTVVTYHIPQKSSLEYVDSRYRNRALMSPAGMLRGDFSLRLFNVTPQDEQKFHCLVLSRSLGFQEVLSVEVTLHVAANFSV

SEQ ID NO: 2422 - protein, 122 aa, Artificial Sequence
  ICOSL v207 IgV
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSV

SEQ ID NO: 2423 - protein, 122 aa, Artificial Sequence
  ICOSL v208 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSNSLGFQEVLSVEVTLHVAANFSV

SEQ ID NO: 2424 - protein, 122 aa, Artificial Sequence
  ICOSL v209 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSPSLGFQEVLSVEVTLHVAANFSV

SEQ ID NO: 2425 - protein, 122 aa, Artificial Sequence
  ICOSL v210 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSRSLGFQEVLSVEVTLHVAANFSV

SEQ ID NO: 2426 - protein, 122 aa, Artificial Sequence
  ICOSL v211 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSTSLGFQEVLSVEVTLHVAANFSV

SEQ ID NO: 2427 - protein, 122 aa, Artificial Sequence
  ICOSL v212 IgV
DTQEKEVRAMVGSDVELSCACPEGSRFDLNDVYVYWQTSESKTVVTYHIPQRSSLEHVDSRYRNRALMSPAGMLRGDFSLRLFNVTPQDEQKFHCLVLSKSLGFQEVLSVEVTLHVAANFSV

SEQ ID NO: 2428 - protein, 122 aa, Artificial Sequence
  ICOSL v213 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSSSLGFQEVLSVEVTLHVAANFSV

SEQ ID NO: 2429 - protein, 122 aa, Artificial Sequence
  ICOSL v214 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSKSLGFQEVLSVEVTLHVAANFSV

SEQ ID NO: 2430 - protein, 122 aa, Artificial Sequence
  ICOSL v215 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSQSLGFQEVLSVEVTLHVAANFSV

SEQ ID NO: 2431 - protein, 122 aa, Artificial Sequence
  ICOSL v216 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSRSLGFQEVLSVEVTLHVAANFSV

SEQ ID NO: 2432 - protein, 122 aa, Artificial Sequence
  ICOSL v217 IgV
DTQEKEVRAMVGSDVELSCACPEGSRFDLNDVYVYWQTSESKTVVTYHIPQCSSLEEVDSRYRNRALMSPAGMLRGDFSLRLFNVTPQDEQKFHCLVLSSSLGFQEVLSVEVTLHVAANFSV

SEQ ID NO: 2433 - protein, 122 aa, Artificial Sequence
  ICOSL v218 IgV
DTQEKEVRAMVGSDVELSCACPEGSRFDLNDVYVYWQTSESKTVVTYHIPQGSSLEPVDSRYRNRALMSPAGMLRGDFSLRLFNVTPQDEQKFHCLVLSDSLGFQEVLSVEVTLHVAANFSV

SEQ ID NO: 2434 - protein, 122 aa, Artificial Sequence
  ICOSL v219 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSGSLGFQEVLSVEVTLHVAANFSV

SEQ ID NO: 2435 - protein, 122 aa, Artificial Sequence
  ICOSL v220 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSQSLGFQEVLSVEVTLHVAANFSV

SEQ ID NO: 2436 - protein, 122 aa, Artificial Sequence
  ICOSL v221 IgV
DTQEKEVRAMVGSDVELSCACPEGSRFDLNDVYVYWQTSESKTVVTYHIPQLSSLEVVDSRYRNRALMSPAGMLRGDFSLRLFNVTPQDEQKFHCLVLSQSLGFQEVLSVEVTLHVAANFSV

SEQ ID NO: 2437 - protein, 122 aa, Artificial Sequence
  ICOSL v222 IgV
DTQEKEVRAMVGSDVELSCACPEGSRFDLNDVYVYWQTSESKTVVTYHIPQPSSLEPVDSRYRNRALMSPAGMLRGDFSLRLFNVTPQDEQKFHCLVLSQSLGFQEVLSVEVTLHVAANFSV

SEQ ID NO: 2438 - protein, 122 aa, Artificial Sequence
  ICOSL v223 IgV
DTQEKEVRAMVGSDVELSCACPEGSRFDLNDVYVYWQTSESKTVVTYHIPQPSSLESVDSRYRNRALMSPAGMLRGDFSLRLFNVTPQDEQKFHCLVLSGSLGFQEVLSVEVTLHVAANFSV

SEQ ID NO: 2439 - protein, 122 aa, Artificial Sequence
  ICOSL v224 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSGSLGFQEVLSVEVTLHVAANFSV

SEQ ID NO: 2440 - protein, 122 aa, Artificial Sequence
  ICOSL v225 IgV
DTQEKEVRAMVGSDVELSCACPEGSRFDLNDVYVYWQTSESKTVVTYHIPQTSSLEKVDSRYRNRALMSPAGMLRGDFSLRLFNVTPQDEQKFHCLVLSPSLGFQEVLSVEVTLHVAANFSV

SEQ ID NO: 2441 - protein, 122 aa, Artificial Sequence
  ICOSL v226 IgV
DTQEKEVRAMVGSDVELSCACPEGSRFDLNDVYVYWQTSESKTVVTYHIPQVSSLETVDSRYRNRALMSPAGMLRGDFSLRLFNVTPQDEQKFHCLVLSLSLGFQEVLSVEVTLHVAANFSV

SEQ ID NO: 2442 - protein, 122 aa, Artificial Sequence
  ICOSL v227 IgV
DTQEKEVRAMVGSDVELSCACPEGSRFDLNDVYVYWQTSESKTVVTYHIPQNSSLEQVDSRYRNRALMSPAGMLRGDFSLRLFNVTPQDEQKFHCLVLSPSLGFQEVLSVEVTLHVAANFSV

SEQ ID NO: 2443 - protein, 111 aa, Artificial Sequence; identical to SEQ ID NO: 2060
  ICOSL v4 IgV

SEQ ID NO: 2444 - protein, 122 aa, Artificial Sequence
  ICOSL v4 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSV

SEQ ID NO: 2445 - protein, 111 aa, Artificial Sequence; identical to SEQ ID NO: 2057
  ICOSL v21 IgV

SEQ ID NO: 2446 - protein, 111 aa, Artificial Sequence; identical to SEQ ID NO: 2069
  ICOSL v24 IgV

SEQ ID NO: 2447 - protein, 122 aa, Artificial Sequence
  ICOSL v24 IgV
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVEVTLHVAANFSV

SEQ ID NO: 2448 - protein, 111 aa, Artificial Sequence; identical to SEQ ID NO: 2071
  ICOSL v30 IgV

SEQ ID NO: 2449 - protein, 122 aa, Artificial Sequence
  ICOSL v30 IgV
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVEVTLHVAANFSV

SEQ ID NO: 2450 - protein, 111 aa, Artificial Sequence; identical to SEQ ID NO: 2073
  ICOSL v34 IgV

SEQ ID NO: 2451 - protein, 111 aa, Artificial Sequence
  ICOSL v96 IgV
DTQEKEVRAMVGSDVELSCACPEGSRFDLNDVYVYWQTSESKAVVTYHIPQHSSLEYVDSRYRNRALMSPAGMQRGDFSLRLFNVTPQGEQKFHCLVLSQSLGFQEVLSDE

SEQ ID NO: 2452 - protein, 111 aa, Artificial Sequence
  ICOSL v45 IgV
DTQEKEVRAMVGSDVELSCACPEGSRFDLNDVYVYWQTSESKTVVTYHIPQHSSLEYVDSSYRNRALMSPAGMLRGDFSLRLFNVTPQDEQKFHCLVLSRSLGFQEVLSDE

SEQ ID NO: 2453 - protein, 122 aa, Artificial Sequence
  ICOSL v45 IgV
DTQEKEVRAMVGSDVELSCACPEGSRFDLNDVYVYWQTSESKTVVTYHIPQHSSLEYVDSSYRNRALMSPAGMLRGDFSLRLFNVTPQDEQKFHCLVLSRSLGFQEVLSDEVTLHVAANFSV

SEQ ID NO: 2454 - protein, 111 aa, Artificial Sequence
  ICOSL v52 IgV
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVE

SEQ ID NO: 2455 - protein, 111 aa, Artificial Sequence
  ICOSL v54 IgV
DTQEKEVRAMVGSDVELSCACPEGSRFDLNDVYVYWQTSESKTVVTHHIPQSSSLENVDSRYRNRALMSPAGMLRGDFSLRLFNVTPQDEQKFHCLVLSQSLGFQEALSVE

SEQ ID NO: 2456 - protein, 111 aa, Artificial Sequence
  ICOSL v56 IgV
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDE

SEQ ID NO: 2457 - protein, 122 aa, Artificial Sequence
  ICOSL v56 IgV
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSV

SEQ ID NO: 2458 - protein, 111 aa, Artificial Sequence
  ICOSL v57 IgV
DTQEKEVRAMVGSDVELSCACPEGSRFDLNDVYVYWRTSESKTVVTYHIPQHSSLEYVDSRYRNRALMSPAGMLRGDFSLRLFNVTPQDEQKFHCLVLSRSLGFQEVLSNE

SEQ ID NO: 2459 - protein, 122 aa, Artificial Sequence
  ICOSL v57 IgV
DTQEKEVRAMVGSDVELSCACPEGSRFDLNDVYVYWRTSESKTVVTYHIPQHSSLEYVDSRYRNRALMSPAGMLRGDFSLRLFNVTPQDEQKFHCLVLSRSLGFQEVLSNEVTLHVAANFSV

SEQ ID NO: 2460 - protein, 111 aa, Artificial Sequence; identical to SEQ ID NO: 2123
  ICOSL v59 IgV

SEQ ID NO: 2461 - protein, 122 aa, Artificial Sequence
  ICOSL v59 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHAAANFSV

SEQ ID NO: 2462 - protein, 111 aa, Artificial Sequence
  ICOSL v61 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLNVE

SEQ ID NO: 2463 - protein, 122 aa, Artificial Sequence
  ICOSL v61 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLNVEVTLHVAANFSV

SEQ ID NO: 2464 - protein, 111 aa, Artificial Sequence
  ICOSL v62 IgV
DTQEKEVRAMVGSDVELRCACPEGSRFDLNDVYVYWQTSESKTVVTYHIPQSSSLENVDSRYRNRALMSPAGMLRGDFSLRLFNVTPQDEQKLHCLVLSQSLGFQEVLSVE

SEQ ID NO: 2465 - protein, 122 aa, Artificial Sequence
  ICOSL v62 IgV
DTQEKEVRAMVGSDVELRCACPEGSRFDLNDVYVYWQTSESKTVVTYHIPQSSSLENVDSRYRNRALMSPAGMLRGDFSLRLFNVTPQDEQKLHCLVLSQSLGFQEVLSVEVTLHVAANFSV

SEQ ID NO: 2466 - protein, 111 aa, Artificial Sequence
  ICOSL v63 IgV
DTQEKEVRAMVGSDVELSCTCPEGSRFDLNDVYVYWQTSESKTVVTYHIPQDSSLENVDSRYRNRALMSPAGMLRGDFSLRLFNVTPQDEQKFHCLVLSQSLGFQEVLSVE

SEQ ID NO: 2467 - protein, 122 aa, Artificial Sequence
  ICOSL v63 IgV
DTQEKEVRAMVGSDVELSCTCPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSV

SEQ ID NO: 2468 - protein, 111 aa, Artificial Sequence
  ICOSL v64 IgV
DTQEKEVRAMEGSDVELSCACPEGSRFDLDDVYVYWQTSESKTVVTYHIPQHSSLEYVDSRYRNRALMSPAGMLRGDFSLRLFNVTPQDEQKFECIVFSQSLGFQEVLSVE

SEQ ID NO: 2469 - protein, 122 aa, Artificial Sequence
  ICOSL v64 IgV
DTQEKEVRAMEGSDVELSCACPEGSRFDLDDVYVYWQTSESKTVVTYHIPQHSSLEYVDSRYRNRALMSPAGMLRGDFSLRLFNVTPQDEQKFECIVFSQSLGFQEVLSVEVTLHVAANFSV

SEQ ID NO: 2470 - protein, 111 aa, Artificial Sequence
  ICOSL v65 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLSVE

SEQ ID NO: 2471 - protein, 111 aa, Artificial Sequence
  ICOSL v66 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFECIVLSQSLGFQEVLSVE

SEQ ID NO: 2472 - protein, 122 aa, Artificial Sequence
  ICOSL v66 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFECIVLSQSLGFQEVLSVEVTLHVAANISV

SEQ ID NO: 2473 - protein, 111 aa, Artificial Sequence
  ICOSL v67 IgV
DTQEKEVRAVVGSDVELRCACPEGSRFDLDDVYVYWQTSESKTVVTYHIPQSSSLENVDSRYRNRALMSPAGMLRGDFSLRLFNVTPQDEQKFHCLVLSQSLGFQEVLSVE

SEQ ID NO: 2474 - protein, 122 aa, Artificial Sequence
  ICOSL v67 IgV
DTQEKEVRAVVGSDVELRCACPEGSRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANFSV

SEQ ID NO: 2475 - protein, 111 aa, Artificial Sequence
  ICOSL v68 IgV
DTQEKEVRAMVGSDVELSCACPEGGRFDLDDVYVYWQTSESKTVVTYHIPQSSSLENVDSRYRNRALMSPAGMLRGDFSLRLFNVTPQDEQKFHCLVLSQSLGFQEVLSVE

SEQ ID NO: 2476 - protein, 122 aa, Artificial Sequence
  ICOSL v68 IgV
DTQEKEVRAMVGSDVELSCACPEGGRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANSSV

SEQ ID NO: 2477 - protein, 111 aa, Artificial Sequence
  ICOSL v69 IgV
DTQEKEVRAMVGSDVELSCACPEGSRFDLDDVYVYWQTSESKTVVTYHIPQSSSLENVDSRYRNRAPMSPAGMLRGDFSLRLFNVTPQDEQKFHCLVLSKSLGFQEVLSVE

SEQ ID NO: 2478 - protein, 122 aa, Artificial Sequence
  ICOSL v69 IgV
DTQEKEVRAMVGSDVELSCACPEGSRFDLDDVYVYWQTSESKTVVTYHIPQSSSLENVDSRYRNRAPMSPAGMLRGDFSLRLFNVTPQDEQKFHCLVLSKSLGFQEVLSVEVTLHVAANFSV

SEQ ID NO: 2479 - protein, 122 aa, Artificial Sequence
  ICOSL v70 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVTANFSV

SEQ ID NO: 2480 - protein, 111 aa, Artificial Sequence
  ICOSL v72 IgV
DTQEKEVRAMVGSDVELSCACPEGGRCDLNDVYVYWQTSESKTVVTYHIPQHSSLEYVDSRYRNRALMSPAGMLRGDFSLRLFNVTPQDEQKFHCLVLSRSLGFQEVLSDE

SEQ ID NO: 2481 - protein, 122 aa, Artificial Sequence
  ICOSL v72 IgV
DTQEKEVRAMVGSDVELSCACPEGGRCDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSV

SEQ ID NO: 2482 - protein, 111 aa, Artificial Sequence
  ICOSL v73 IgV
DTQEKEVRAIVGGDVELSCACPEGSRFDLNDVYVYWQTSESKTVVTYHIPQHSSLEYVDSRYRNRALMSPAGMLRGGFSLRLFNVTPQDEQKFHCLVLSQSLGFQEVLSAE

SEQ ID NO: 2483 - protein, 122 aa, Artificial Sequence
  ICOSL v73 IgV
DTQEKEVRAIVGGDVELSCACPEGSRFDLNDVYVYWQTSESKTVVTYHIPQHSSLEYVDSRYRNRALMSPAGMLRGGFSLRLFNVTPQDEQKFHCLVLSQSLGFQEVLSAEVTLHVAANFSV

SEQ ID NO: 2484 - protein, 111 aa, Artificial Sequence; identical to SEQ ID NO: 2482
  ICOSL v74 IgV

SEQ ID NO: 2485 - protein, 122 aa, Artificial Sequence; identical to SEQ ID NO: 2483
  ICOSL v74 IgV

SEQ ID NO: 2486 - protein, 111 aa, Artificial Sequence
  ICOSL v75 IgV
DTQEKEVRAMVGSDVELSCACPEGSRFDLNDVYVYWQTSESKTVVTYHIPQHSSLEYVDSCFRNRALMSPAGMLRGDFSLRLFNVTPQDEQKFHCLVLSRSLGFQEVLSNE

SEQ ID NO: 2487 - protein, 122 aa, Artificial Sequence
  ICOSL v75 IgV
DTQEKEVRAMVGSDVELSCACPEGSRFDLNDVYVYWQTSESKTVVTYHIPQHSSLEYVDSCFRNRALMSPAGMLRGDFSLRLFNVTPQDEQKFHCLVLSRSLGFQEVLSNEVTLHVAANSSV

SEQ ID NO: 2488 - protein, 122 aa, Artificial Sequence
  ICOSL v76 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSV

SEQ ID NO: 2489 - protein, 111 aa, Artificial Sequence; identical to SEQ ID NO: 2123
  ICOSL v81 IgV

SEQ ID NO: 2490 - protein, 122 aa, Artificial Sequence; identical to SEQ ID NO: 2262
  ICOSL v81 IgV

SEQ ID NO: 2491 - protein, 111 aa, Artificial Sequence
  ICOSL v84 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSDE

SEQ ID NO: 2492 - protein, 122 aa, Artificial Sequence
  ICOSL v84 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSDEVTLRVAANFSV

SEQ ID NO: 2493 - protein, 111 aa, Artificial Sequence
  ICOSL v92 IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSQSLGFQEVLSDE

SEQ ID NO: 2494 - protein, 122 aa, Artificial Sequence; identical to SEQ ID NO: 2286
  ICOSL v92 IgV

SEQ ID NO: 2495 - protein, 122 aa, Artificial Sequence
  ICOSL v96 IgV
DTQEKEVRAMVGSDVELSCACPEGSRFDLNDVYVYWQTSESKAVVTYHIPQHSSLEYVDSRYRNRALMSPAGMQRGDFSLRLFNVTPQGEQKFHCLVLSQSLGFQEVLSDEVTLHVAANFSV

SEQ ID NO: 2496 - protein, 111 aa, Artificial Sequence
  ICOSL v98 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEILSDE

SEQ ID NO: 2497 - protein, 122 aa, Artificial Sequence
  ICOSL v98 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEILSDEVTLHVAANFSV

SEQ ID NO: 2498 - protein, 111 aa, Artificial Sequence
  ICOSL v103 IgV
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVE

SEQ ID NO: 2499 - protein, 122 aa, Artificial Sequence
  ICOSL v103 IgV
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAANFSV

SEQ ID NO: 2500 - protein, 111 aa, Artificial Sequence
  ICOSL v126 IgV
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVE

SEQ ID NO: 2501 - protein, 122 aa, Artificial Sequence; identical to SEQ ID NO: 2287
  ICOSL v106 IgV

SEQ ID NO: 2502 - protein, 122 aa, Artificial Sequence
  ICOSL v127 IgV
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAANFSV

SEQ ID NO: 2503 - protein, 122 aa, Artificial Sequence; identical to SEQ ID NO: 2288
  ICOSL v108 IgV

SEQ ID NO: 2504 - protein, 122 aa, Artificial Sequence
  ICOSL v129 IgV
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSV

SEQ ID NO: 2505 - protein, 111 aa, Artificial Sequence
  ICOSL v140 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSRSLGFQEVLSVE

SEQ ID NO: 2506 - protein, 122 aa, Artificial Sequence
  ICOSL v140 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSRSLGFQEVLSVEVTLHVAANFSV

SEQ ID NO: 2507 - protein, 111 aa, Artificial Sequence; identical to SEQ ID NO: 2207
  ICOSL v142 IgV

SEQ ID NO: 2508 - protein, 122 aa, Artificial Sequence; identical to SEQ ID NO: 2293
  ICOSL v142 IgV

SEQ ID NO: 2509 - protein, 122 aa, Artificial Sequence
  ICOSL v177 IgV
  VARIANT (115)..(115): x is H or Q
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLXVAANFSV

SEQ ID NO: 2510 - protein, 111 aa, Artificial Sequence
  ICOSL v148 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSVE

SEQ ID NO: 2511 - protein, 122 aa, Artificial Sequence
  ICOSL v148 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSVEVTLRVAANFSV

SEQ ID NO: 2512 - protein, 122 aa, Artificial Sequence
  ICOSL v149 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSA

SEQ ID NO: 2513 - protein, 122 aa, Artificial Sequence
  ICOSL v158 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSV

SEQ ID NO: 2514 - protein, 122 aa, Artificial Sequence
  ICOSL v169 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANFSV

SEQ ID NO: 2515 - protein, 111 aa, Artificial Sequence
  ICOSL v160 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSPSLGFQEVLSVE

SEQ ID NO: 2516 - protein, 122 aa, Artificial Sequence
  ICOSL v160 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSPSLGFQEVLSVEVTLHVAANFSV

SEQ ID NO: 2517 - protein, 111 aa, Artificial Sequence; identical to SEQ ID NO: 2136
  ICOSL v164 IgV

SEQ ID NO: 2518 - protein, 122 aa, Artificial Sequence
  ICOSL v168 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANSSV

SEQ ID NO: 2519 - protein, 127 aa, Artificial Sequence
  CTLA-4 ECD
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQ

SEQ ID NO: 2520 - protein, 127 aa, Artificial Sequence
  CTLA-4 ECD
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQ

SEQ ID NO: 2521 - protein, 121 aa, Artificial Sequence
  IL16
SAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 2522 - protein, 246 aa, Artificial Sequence
  OKT3
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTVTVSAGGGGSGGGGSGGGSSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGDP

SEQ ID NO: 2523 - protein, 5 aa, Artificial Sequence
  Linker
GSGGS

SEQ ID NO: 2524 - protein, 7 aa, Artificial Sequence
  Linker
GGGGSSA

SEQ ID NO: 2525 - DNA, 1182 bp, Artificial Sequence
  CTLA-4 2519 - Fc
gccgccaccatggggtcaaccgccatcctcgccctcctcctggctgttctccaaggagtcagcgctaaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtgtccagatagtgatcaggggggaggtggatccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtgcagagaagaaatgaccaagaatcaagtttccctgtggtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggggattacaaggatgacgacgataagtag

SEQ ID NO: 2526 - protein, 371 aa, Artificial Sequence
  CTLA-4 2519 - Fc
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGDYKDDDDK

SEQ ID NO: 2527 - DNA, 1131 bp, Artificial Sequence
  PD-L2 1417 - Fc
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttgcactttgcccccgtcaagagaagaaatgaccaagaatcaagtttccctgtcttgcgcagtgaagggcttctaccctagcgatatagcagttgagtgggaatctaacggccagcccgaaaataattataagactactccgcccgtgctggacagtgatggttcatttttcctggtttcaaaactcactgtggacaaatctagatggcagcagggtaatgtgttctcttgttcagttatgcacgaggcattgcacaatcactatacgcaaaaaagtttgtctctctctccggggcaccatcatcaccatcactag

SEQ ID NO: 2528 - protein, 354 aa, Artificial Sequence
  PD-L2 1417 - Fc
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGHHHHHH

SEQ ID NO: 2529 - protein, 860 aa, Artificial Sequence
  Anti-CD3 scFv - PD-L1 303- PD-L1 303- PD-L1 303-Fc
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTVTVSAGGGGSGGGGSGGGSSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGDPGGGGSSAFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2530 - protein, 735 aa, Artificial Sequence
  IL16 - PD-L1 303 - PD-L1 303 - PD-L1 303 - Fc
SAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDSGGGGSSAFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2531 - protein, 741 aa, Artificial Sequence
  CTLA-4 2519 - PD-L1 303 - PD-L1 303 - PD-L1 303 - Fc
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQGGGGSSAFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2532 - DNA, 786 bp, Artificial Sequence
  CTLA-4 2520 - PD-L1 303 - Fc
aaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtctccagatagtgatcagggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggtggaggtgggtca

SEQ ID NO: 2533 - protein, 500 aa, Artificial Sequence
  CTLA-4 2520 - PD-L1 303 - Fc
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2534 - DNA, 747 bp, Artificial Sequence
  CTLA-4 2520 - PD-L2 1417 - Fc
aaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtctccagatagtgatcagggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggtggaggtgggtca

SEQ ID NO: 2535 - protein, 487 aa, Artificial Sequence
  CTLA-4 2520 - PD-L2 1417 - Fc
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2536 - protein, 786 aa, Artificial Sequence
  PD-L1 303 - CTLA-4 2519 - Fc
TTTACCGTAACGGTCCCTAAGGATTTGTACGTGGTTGAGTACGGGAGCAATATGACGATTGAATGCAAGTTCCCCGTAGAGAAGCAGCTCGATTTGGCCGCTTTGATAGTGTACTGGGAAATGGAAGGAAAAGACATCATTCAATTCGTCCACGGTGAAGAGGATCAAAAAGCGCAACATAGCTCCTATAGACAACGCGCACGCTTGCTTAAAGACCAGCTGAGTCTTGGTAACGCGGCGCTGCAGATTACCGACGTAAAACTTCAAGACGCGGGAGTTTATCGCTGCATGATTTCCTACGGGGGTGGCGCAGACTATAAAAGGATCACTGTAAAGGTAAACGCCGGATCCGGAGGGTCTGGGGGAGGCGGTTCTGGGGGTGGAGGCTCAAAGGCGATGCACGTAGCCCAGCCCGCTGTTGTTCTCGCAAGTTCTCGCGGCATAGCCTCCTTCGTATGTGAGTATGCCAGTCCAGGTAAGTACACGGAGGTACGGGTAACTGTACTGCGGCAGGCCGATTCCCAGGTTACGGAGGTTTGTGCGGCAACCTACATGATGGGTAACGAGCTTACATTTCTCGACGACTCAATATGTACTGGGACCTCCTCAGGAAATCAGGTCAATCTGACCATCCAAGGTCTGAGGGCGATGGATACGGGTCTTTATATTTGCAAGGTTGAACTCATGTATCCGCCTCCATACTATGAAGGCATTGGAAATGGAACACAAATCTATGTTATTGACCCGGAGCCGTGTCCAGATAGTGATCAGGGTGGAGGTGGGTCA

SEQ ID NO: 2537 - protein, 500 aa, Artificial Sequence
  PD-L1 303 - CTLA-4 2519 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSKAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2538 - protein, 747 aa, Artificial Sequence
  PD-L2 1417 - CTLA-4 2519 - Fc
TTATTCACAGTGACTGTTCCGAAAGAGTTGTATATAATCGAGCAAGGGAGTAATGTTACCCTGGAATGCAATTTTGACACCGGGTCACACGTCAACCTCGGAGCGATTACTGCTTCTTTGCAAAAAGTTGAAAACGACGCGTCCCCCCATAGGGAAAGGGCGACCCTTCTGGAGGAGCAGTTGCCCCTTGGCAGGGCACTCTTTCACATTCCCCAGGTGCAAGTCAGGGACGAGGGGCAATACCGCTGCATCATAATTTACGGGGACGCGTGGGACTACAAGTACTTGACTCTCAAAGTTAAAGCTGGATCCGGAGGGTCTGGGGGAGGCGGTTCTGGGGGTGGAGGCTCAAAGGCGATGCACGTAGCCCAGCCCGCTGTTGTTCTCGCAAGTTCTCGCGGCATAGCCTCCTTCGTATGTGAGTATGCCAGTCCAGGTAAGTACACGGAGGTACGGGTAACTGTACTGCGGCAGGCCGATTCCCAGGTTACGGAGGTTTGTGCGGCAACCTACATGATGGGTAACGAGCTTACATTTCTCGACGACTCAATATGTACTGGGACCTCCTCAGGAAATCAGGTCAATCTGACCATCCAAGGTCTGAGGGCGATGGATACGGGTCTTTATATTTGCAAGGTTGAACTCATGTATCCGCCTCCATACTATGAAGGCATTGGAAATGGAACACAAATCTATGTTATTGACCCGGAGCCGTGTCCAGATAGTGATCAGGGTGGAGGTGGGTCA

SEQ ID NO: 2539 - protein, 487 aa, Artificial Sequence
  PD-L2 1417 - CTLA-4 2519 - Fc
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSKAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2540 - DNA, 1494 bp, Artificial Sequence
  PD-L1 303 - Fc - CTLA-4 2520
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggggtggaggtggctctggaggtggtggaagcggtggcggtggtagcaaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgagcccagatagtgatcag

SEQ ID NO: 2541 - protein, 500 aa, Artificial Sequence
  PD-L1 303 - Fc - CTLA-4 2520
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSKAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQ

SEQ ID NO: 2542 - DNA, 1455 bp, Artificial Sequence
  PD-L2 1417 - Fc - CTLA-4 2520
ttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggggtggaggtggctctggaggtggtggaagcggtggcggtggtagcaaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgagcccagatagtgatcag

SEQ ID NO: 2543 - protein, 487 aa, Artificial Sequence
  PD-L2 1417 - Fc - CTLA-4 2520
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSKAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQ

SEQ ID NO: 2544 - protein, 231 aa, Artificial Sequence
  K Chain
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 2545 - protein, 231 aa, Artificial Sequence
  D chain
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPG

SEQ ID NO: 2546 - DNA, 1107 bp, Artificial Sequence
  PD-L2 1417 - Fc
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgggggaggtggatccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagaaagaaaatgaccaagaatcaagtttccctgacgtgccttgtgaagggcttctaccctagcgatatagcagttgagtgggaatctaacggccagcccgaaaataattataagactactccgcccgtgctgaaaagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggggattacaaggatgacgacgataagtag

SEQ ID NO: 2547 - protein, 346 aa, Artificial Sequence
  PD-L2 1417 - Fc
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGDYKDDDDK

SEQ ID NO: 2548 - DNA, 1161 bp, Artificial Sequence
  ICOSL 2244 - Fc
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtggggggaggtggatccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagaggaaatgaccaagaatcaagtttccctgacgtgccttgtggacggcttctaccctagcgatatagcagttgagtgggaatctaacggccagcccgaaaataattatgacactactccgcccgtgctggacagtgatggttcatttttcctgtattcagacctcactgtggacaaatctagatggcagcagggtaatgtgttctcttgttcagttatgcacgaggcattgcacaatcactatacgcaaaaaagtttgtctctctctccggggcaccatcatcaccatcactag

SEQ ID NO: 2549 - protein, 364 aa, Artificial Sequence
  ICOSL 2244 - Fc
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGHHHHHH

SEQ ID NO: 2550 - DNA, 1161 bp, Artificial Sequence
  ICOSL 2264 - Fc
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggggggaggtggatccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagaggaaatgaccaagaatcaagtttccctgacgtgccttgtggacggcttctaccctagcgatatagcagttgagtgggaatctaacggccagcccgaaaataattatgacactactccgcccgtgctggacagtgatggttcatttttcctgtattcagacctcactgtggacaaatctagatggcagcagggtaatgtgttctcttgttcagttatgcacgaggcattgcacaatcactatacgcaaaaaagtttgtctctctctccggggcaccatcatcaccatcactag

SEQ ID NO: 2551 - protein, 364 aa, Artificial Sequence
  ICOSL 2264 - Fc
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGHHHHHH

SEQ ID NO: 2552 - DNA, 1146 bp, Artificial Sequence
  PD-L1 303 - Fc
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgggggaggtggatccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagaaagaaaatgaccaagaatcaagtttccctgacgtgccttgtgaagggcttctaccctagcgatatagcagttgagtgggaatctaacggccagcccgaaaataattataagactactccgcccgtgctgaaaagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggggattacaaggatgacgacgataagtga

SEQ ID NO: 2553 - protein, 359 aa, Artificial Sequence
  PD-L1 303 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGDYKDDDDK

SEQ ID NO: 2554 - DNA, 1119 bp, Artificial Sequence
  CD80 2615 - Fc
gccgccaccatggggtcaaccgccatcctcgccctcctcctggctgttctccaaggagtcagcgctgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgacatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttcgggggaggtggatccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagaggaaatgaccaagaatcaagtttccctgacgtgccttgtggacggcttctaccctagcgatatagcagttgagtgggaatctaacggccagcccgaaaataattatgacactactccgcccgtgctggacagtgatggttcatttttcctgtattcagacctcactgtggacaaatctagatggcagcagggtaatgtgttctcttgttcagttatgcacgaggcattgcacaatcactatacgcaaaaaagtttgtctctctctccggggcaccatcatcaccatcactag

SEQ ID NO: 2555 - protein, 350 aa, Artificial Sequence
  CD80 2615 - Fc
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGHHHHHH

SEQ ID NO: 2556 - DNA, 1095 bp, Artificial Sequence
  CD80 1152 - Fc
gccgccaccatggggtcaaccgccatcctcgccctcctcctggctgttctccaaggagtcagcgctgttatccacgtgaccaaggaagtgaaagaagtggcaacgctgtcctgtggtcacaatgtttctctggaagagctggcacaaactcgcatctactggcaaaagggtaagaaaatggtgctgactatgatgtctggggacatgaatatatggcccgagtacaagaaccggaccatctttgacatcactaataacctctccattgtgatcctggacccacgcccatctgacgagggcacatacgagtgtgttgttctgaagtatgaaaaagacgctttcaagcgggaacacctggctgaagtggggggaggtggatccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagaggaaatgaccaagaatcaagtttccctgacgtgccttgtggacggcttctaccctagcgatatagcagttgagtgggaatctaacggccagcccgaaaataattatgacactactccgcccgtgctggacagtgatggttcatttttcctgtattcagacctcactgtggacaaatctagatggcagcagggtaatgtgttctcttgttcagttatgcacgaggcattgcacaatcactatacgcaaaaaagtttgtctctctctccggggcaccatcatcaccatcactag

SEQ ID NO: 2557 - protein, 342 aa, Artificial Sequence
  CD80 1152 - Fc
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGHHHHHH

SEQ ID NO: 2558 - protein, 231 aa, Artificial Sequence
  Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 2559 - protein, 231 aa, Artificial Sequence
  Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPG

SEQ ID NO: 2560 - DNA, 1170 bp, Artificial Sequence
  PD-L1 303 - Fc
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttgcactttgcccccgtcaagagaagaaatgaccaagaatcaagtttccctgtcttgcgcagtgaagggcttctaccctagcgatatagcagttgagtgggaatctaacggccagcccgaaaataattataagactactccgcccgtgctggacagtgatggttcatttttcctggtttcaaaactcactgtggacaaatctagatggcagcagggtaatgtgttctcttgttcagttatgcacgaggcattgcacaatcactatacgcaaaaaagtttgtctctctctccggggcaccatcatcaccatcactag

SEQ ID NO: 2561 - protein, 367 aa, Artificial Sequence
  PD-L1 303 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGHHHHHH

SEQ ID NO: 2562 - DNA, 1239 bp, Artificial Sequence
  OKT3 - PD-L1 303
gccgccaccatggggtcaaccgccatcctcgccctcctcctggctgttctccaaggagtcagcgctcaggtccagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccacggtgaccgtgagcgccgggggaggtggcagcgggggaggtggcagcggcggcgggagctcccaaattgttctcacccagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggcggtggcgatcccggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2563 - protein, 390 aa, Artificial Sequence
  OKT3 - PD-L1 303
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTVTVSAGGGGSGGGGSGGGSSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGDPGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2564 - DNA, 1200 bp, Artificial Sequence
  OKT3 - PD-L2 1417
gccgccaccatggggtcaaccgccatcctcgccctcctcctggctgttctccaaggagtcagcgctcaggtccagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccacggtgaccgtgagcgccgggggaggtggcagcgggggaggtggcagcggcggcgggagctcccaaattgttctcacccagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggcggtggcgatcccggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2565 - protein, 377 aa, Artificial Sequence
  OKT3 - PD-L2 1417
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTVTVSAGGGGSGGGGSGGGSSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGDPGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2566 - DNA, 1230 bp, Artificial Sequence
  PD-L1 303 - OKT3
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcacaggtccagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccacggtgaccgtgagcgccgggggaggtggcagcgggggaggtggcagcggcggcgggagctcccaaattgttctcacccagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggcggtggcgatcccgattacaaggatgacgacgataagcaccatcatcaccatcactag

SEQ ID NO: 2567 - protein, 390 aa, Artificial Sequence
  PD-L1 303 - OKT3
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTVTVSAGGGGSGGGGSGGGSSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGDPDYKDDDDKHHHHHH

SEQ ID NO: 2568 - DNA, 1191 bp, Artificial Sequence
  PD-L2 1417 - OKT3
atggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcacaggtccagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccacggtgaccgtgagcgccgggggaggtggcagcgggggaggtggcagcggcggcgggagctcccaaattgttctcacccagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggcggtggcgatcccgattacaaggatgacgacgataagcaccatcatcaccatcactag

SEQ ID NO: 2569 - protein, 377 aa, Artificial Sequence
  PD-L2 1417 - OKT3
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSQVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTVTVSAGGGGSGGGGSGGGSSQIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRGGGDPDYKDDDDKHHHHHH

SEQ ID NO: 2570 - DNA, 855 bp, Artificial Sequence
  PD-L1 303 - IL16
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcaagcgccgcttctgcctcagcagccagcgatgtctctgtcgaaagcacggcggaagctactgtttgtactgtcacccttgagaaaatgagcgcgggtttggggttttcactcgagggcggcaaagggtcacttcacggcgacaaaccattgacaatcaatcggatatttaaaggtgctgcctctgaacagagcgaaactgttcaaccgggcgatgaaatactgcaactgggtggtacagccatgcagggcctgacgcgcttcgaggcgtggaacattataaaagcactgcctgatggtccagtcacaatagtcatccgccggaaatcacttcaatcaaaggagaccaccgctgcgggagacagcgattacaaggatgacgacgataagcaccatcatcaccatcactag

SEQ ID NO: 2571 - protein, 265 aa, Artificial Sequence
  PD-L1 303 - IL16
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDSDYKDDDDKHHHHHH

SEQ ID NO: 2572 - DNA, 855 bp, Artificial Sequence
  IL16 - PD-L1 303
atggggtcaaccgccatcctcgccctcctcctggctgttctccaaggagtcagcgctagcgccgcttctgcctcagcagccagcgatgtctctgtcgaaagcacggcggaagctactgtttgtactgtcacccttgagaaaatgagcgcgggtttggggttttcactcgagggcggcaaagggtcacttcacggcgacaaaccattgacaatcaatcggatatttaaaggtgctgcctctgaacagagcgaaactgttcaaccgggcgatgaaatactgcaactgggtggtacagccatgcagggcctgacgcgcttcgaggcgtggaacattataaaagcactgcctgatggtccagtcacaatagtcatccgccggaaatcacttcaatcaaaggagaccaccgctgcgggagacagcggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2573 - protein, 265 aa, Artificial Sequence
  IL16 - PD-L1 303
SAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDSGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2574 - DNA, 825 bp, Artificial Sequence
  PD-L2 1417 - IL16
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcaagcgccgcttctgcctcagcagccagcgatgtctctgtcgaaagcacggcggaagctactgtttgtactgtcacccttgagaaaatgagcgcgggtttggggttttcactcgagggcggcaaagggtcacttcacggcgacaaaccattgacaatcaatcggatatttaaaggtgctgcctctgaacagagcgaaactgttcaaccgggcgatgaaatactgcaactgggtggtacagccatgcagggcctgacgcgcttcgaggcgtggaacattataaaagcactgcctgatggtccagtcacaatagtcatccgccggaaatcacttcaatcaaaggagaccaccgctgcgggagacagcgattacaaggatgacgacgataagcaccatcatcaccatcactag

SEQ ID NO: 2575 - protein, 252 aa, Artificial Sequence
  PD-L2 1417 - IL16
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDSDYKDDDDKHHHHHH

SEQ ID NO: 2576 - DNA, 825 bp, Artificial Sequence
  IL16 - PD-L2 1417
gccgccaccatggggtcaaccgccatcctcgccctcctcctggctgttctccaaggagtcagcgctagcgccgcttctgcctcagcagccagcgatgtctctgtcgaaagcacggcggaagctactgtttgtactgtcacccttgagaaaatgagcgcgggtttggggttttcactcgagggcggcaaagggtcacttcacggcgacaaaccattgacaatcaatcggatatttaaaggtgctgcctctgaacagagcgaaactgttcaaccgggcgatgaaatactgcaactgggtggtacagccatgcagggcctgacgcgcttcgaggcgtggaacattataaaagcactgcctgatggtccagtcacaatagtcatccgccggaaatcacttcaatcaaaggagaccaccgctgcgggagacagcggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2577 - protein, 252 aa, Artificial Sequence
  IL16 - PD-L2 1417
SAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDSGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2578 - DNA, 828 bp, Artificial Sequence
  PD-L2 1417 - ICOSL 2247
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacaggacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtggattacaaggatgacgacgataagcaccatcatcaccatcactag

SEQ ID NO: 2579 - protein, 253 aa, Artificial Sequence
  PD-L2 1417 - ICOSL 2247
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSDTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVDYKDDDDKHHHHHH

SEQ ID NO: 2580 - DNA, 828 bp, Artificial Sequence
  ICOSL 2247 - PD-L2 1417
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacaggacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2581 - protein, 253 aa, Artificial Sequence
  ICOSL 2247 - PD-L2 1417
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2582 - DNA, 828 bp, Artificial Sequence
  PD-L2 1417 - ICOSL 2266
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcactag

SEQ ID NO: 2583 - protein, 253 aa, Artificial Sequence
  PD-L2 1417 - ICOSL 2266
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVDYKDDDDKHHHHHH

SEQ ID NO: 2584 - DNA, 828 bp, Artificial Sequence
  ICOSL 2266 - PD-L2 1417
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2585 - protein, 253 aa, Artificial Sequence
  ICOSL 2266 - PD-L2 1417
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2586 - DNA, 828 bp, Artificial Sequence
  PD-L2 1417 - ICOSL 2264
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcactag

SEQ ID NO: 2587 - protein, 253 aa, Artificial Sequence
  PD-L2 1417 - ICOSL 2264
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVDYKDDDDKHHHHHH

SEQ ID NO: 2588 - DNA, 828 bp, Artificial Sequence
  ICOSL 2264 - PD-L2 1417
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2589 - protein, 253 aa, Artificial Sequence
  ICOSL 2264 - PD-L2 1417
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2590 - DNA, 828 bp, Artificial Sequence
  PD-L2 1417 - ICOSL 2244
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtggattacaaggatgacgacgataagcaccatcatcaccatcactag

SEQ ID NO: 2591 - protein, 253 aa, Artificial Sequence
  PD-L2 1417 - ICOSL 2244
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSDTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVDYKDDDDKHHHHHH

SEQ ID NO: 2592 - DNA, 828 bp, Artificial Sequence
  ICOSL 2244 - PD-L2 1417
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2593 - protein, 253 aa, Artificial Sequence
  ICOSL 2244 - PD-L2 1417
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2594 - DNA, 867 bp, Artificial Sequence
  PD-L1 303 - ICOSL 2247
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacaggacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtggattacaaggatgacgacgataagcaccatcatcaccatcactag

SEQ ID NO: 2595 - protein, 266 aa, Artificial Sequence
  PD-L1 303 - ICOSL 2247
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSDTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVDYKDDDDKHHHHHH

SEQ ID NO: 2596 - DNA, 867 bp, Artificial Sequence
  ICOSL 2247 - PD-L1 303
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacaggacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2597 - protein, 266 aa, Artificial Sequence
  ICOSL 2247 - PD-L1 303
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2598 - DNA, 867 bp, Artificial Sequence
  PD-L1 303 - ICOSL 2266
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcactag

SEQ ID NO: 2599 - protein, 266 aa, Artificial Sequence
  PD-L1 303 - ICOSL 2266
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVDYKDDDDKHHHHHH

SEQ ID NO: 2600 - DNA, 867 bp, Artificial Sequence
  ICOSL 2266 - PD-L1 303
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2601 - protein, 266 aa, Artificial Sequence
  ICOSL 2266 - PD-L1 303
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2602 - DNA, 867 bp, Artificial Sequence
  PD-L1 303 - ICOSL 2264
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcactag

SEQ ID NO: 2603 - protein, 266 aa, Artificial Sequence
  PD-L1 303 - ICOSL 2264
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVDYKDDDDKHHHHHH

SEQ ID NO: 2604 - DNA, 867 bp, Artificial Sequence
  ICOSL 2264 - PD-L1 303
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2605 - protein, 266 aa, Artificial Sequence
  ICOSL 2264 - PD-L1 303
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2606 - DNA, 867 bp, Artificial Sequence
  PD-L1 303 - ICOSL 2244
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtggattacaaggatgacgacgataagcaccatcatcaccatcactag

SEQ ID NO: 2607 - protein, 266 aa, Artificial Sequence
  PD-L1 303 - ICOSL 2244
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSDTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVDYKDDDDKHHHHHH

SEQ ID NO: 2608 - DNA, 867 bp, Artificial Sequence
  ICOSL 2244 - PD-L1 303
gccgccaccatggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2609 - protein, 266 aa, Artificial Sequence
  ICOSL 2244 - PD-L1 303
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2610 - protein, 132 aa, Homo sapiens
  MISC_FEATURE: Wildtype CD86 IgV
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINL

SEQ ID NO: 2611 - DNA, 858 bp, Artificial Sequence
  PD-L2 1417 - CD86 2610
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttggattacaaggatgacgacgataagcaccatcatcaccatcactag

SEQ ID NO: 2612 - protein, 263 aa, Artificial Sequence
  PD-L2 1417 - CD86 2610
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLDYKDDDDKHHHHHH

SEQ ID NO: 2613 - DNA, 858 bp, Artificial Sequence
  CD86 2610 - PD-L2 1417
gccgccaccatggggtcaaccgccatcctcgccctcctcctggctgttctccaaggagtcagcgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2614 - protein, 262 aa, Artificial Sequence
  CD86 2610 - PD-L2 1417
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHH

SEQ ID NO: 2615 - protein, 108 aa, Homo sapiens
  MISC_FEATURE: Wildtype CD80 IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADF

SEQ ID NO: 2616 - protein, 100 aa, Artificial Sequence
  CD80 v165  IgV
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEV

SEQ ID NO: 2617 - protein, 100 aa, Artificial Sequence
  CD80 v191 IgV
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEV

SEQ ID NO: 2618 - DNA, 786 bp, Artificial Sequence
  PD-L2 1417 - CD80 2615
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgacatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttcgattacaaggatgacgacgataagcaccatcatcaccatcactag

SEQ ID NO: 2619 - protein, 239 aa, Artificial sequence
  PD-L2 1417 - CD80 2615
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFDYKDDDDKHHHHHH

SEQ ID NO: 2620 - DNA, 786 bp, Artificial Sequence
  CD80 2615 - PD-L2 1417
gccgccaccatggggtcaaccgccatcctcgccctcctcctggctgttctccaaggagtcagcgctgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgacatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttcggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2621 - protein, 239 aa, Artificial Sequence
  CD80 2615 - PD-L2 1417
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2622 - DNA, 762 bp, Artificial Sequence
  PD-L2 1417 - CD80 2616
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagttatccacgtgaccaaggaagtgaaagaagtggcaacgctgtcctgtggtcacaatgtttctctggaagagctggcacaaactcgcatctactggcaaaagggtaagaaaatggtgctgactatgatgtctggggacatgaatatatggcccgagtacaagaaccggaccatctttgacatcactaataacctctccattgtgatcctggacccacgcccatctgacgagggcacatacgagtgtgttgttctgaagtatgaaaaagacgctttcaagcgggaacacctggctgaagtggattacaaggatgacgacgataagcaccatcatcaccatcactag

SEQ ID NO: 2623 - protein, 231 aa, Artificial Sequence
  PD-L2 1417 - CD80 2616
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSVIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVDYKDDDDKHHHHHH

SEQ ID NO: 2624 - DNA, 762 bp, Artificial Sequence
  CD80 2616 - PD-L2 1417
gccgccaccatggggtcaaccgccatcctcgccctcctcctggctgttctccaaggagtcagcgctgttatccacgtgaccaaggaagtgaaagaagtggcaacgctgtcctgtggtcacaatgtttctctggaagagctggcacaaactcgcatctactggcaaaagggtaagaaaatggtgctgactatgatgtctggggacatgaatatatggcccgagtacaagaaccggaccatctttgacatcactaataacctctccattgtgatcctggacccacgcccatctgacgagggcacatacgagtgtgttgttctgaagtatgaaaaagacgctttcaagcgggaacacctggctgaagtgggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2625 - protein, 231 aa, Artificial Sequence
  CD80 2616 - PD-L2 1417
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2626 - DNA, 762 bp, Artificial Sequence
  PD-L2 1417 - CD80 2617
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagttatccacgtgaccaaggaagtgaaagaagtggcaacgctgtcctgtggtcacaatgtttctgttgaagagctggcacaaactcgcatctactggcaaaagggtaagaaaatggtgctgactatgatgtctggggacatgaatatatggcccgagtacgaaaaccggaccatctttgacatcactaataacctctccattgtgatcctggacccacgcccatctgacgagggcacatacgagtgtgttgttctgaagtatgaaaaagacgctttcaagcgggaacacctggctgaagtggattacaaggatgacgacgataagcaccatcatcaccatcactag

SEQ ID NO: 2627 - protein, 231 aa, Artificial Sequence
  PD-L2 1417 - CD80 2617
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSVIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVDYKDDDDKHHHHHH

SEQ ID NO: 2628 - DNA, 762 bp, Artificial Sequence
  CD80 2617 - PD-L2 1417
gccgccaccatggggtcaaccgccatcctcgccctcctcctggctgttctccaaggagtcagcgctgttatccacgtgaccaaggaagtgaaagaagtggcaacgctgtcctgtggtcacaatgtttctgttgaagagctggcacaaactcgcatctactggcaaaagggtaagaaaatggtgctgactatgatgtctggggacatgaatatatggcccgagtacgaaaaccggaccatctttgacatcactaataacctctccattgtgatcctggacccacgcccatctgacgagggcacatacgagtgtgttgttctgaagtatgaaaaagacgctttcaagcgggaacacctggctgaagtgggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2629 - protein, 231 aa, Artificial Sequence
  CD80 2617 - PD-L2 1417
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2630 - DNA, 897 bp, Artificial Sequence
  PD-L1 303 - CD86 2610
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttggattacaaggatgacgacgataagcaccatcatcaccatcactag

SEQ ID NO: 2631 - protein, 276 aa, Artificial Sequence
  PD-L1 303 - CD86 2610
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLDYKDDDDKHHHHHH

SEQ ID NO: 2632 - DNA, 897 bp, Artificial Sequence
  CD86 2610 - PD-L1 303
gccgccaccatggggtcaaccgccatcctcgccctcctcctggctgttctccaaggagtcagcgctgctcctctgaagattcaagcttatttcaatgagactgcagacctgccatgccaatttgcaaactctcaaaaccaaagcctgagtgagctagtagtattttggcaggaccaggaaaacttggttctgaatgaggtatacttaggcaaagagaaatttgacagtgttcattccaagtatatgggccgcacaagttttgattcggacagttggaccctgagacttcacaatcttcagatcaaggacaagggcttgtatcaatgtatcatccatcacaaaaagcccacaggaatgattcgcatccaccagatgaattctgaactgtcagtgcttgctaacttcagtcaacctgaaatagtaccaatttctaatataacagaaaatgtgtacataaatttgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2633 - protein, 276 aa, Artificial Sequence
  CD86 2610 - PD-L1 303
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2634 - DNA, 825 bp, Artificial Sequence
  PD-L1 303  - CD80 2615
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgacatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttcgattacaaggatgacgacgataagcaccatcatcaccatcactag

SEQ ID NO: 2635 - protein, 252 aa, Artificial Sequence
  PD-L1 303  - CD80 2615
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFDYKDDDDKHHHHHH

SEQ ID NO: 2636 - DNA, 825 bp, Artificial Sequence
  CD80 2615 - PD-L1 303
gccgccaccatggggtcaaccgccatcctcgccctcctcctggctgttctccaaggagtcagcgctgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgacatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttcggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2637 - protein, 252 aa, Artificial Sequence
  CD80 2615 - PD-L1 303
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2638 - DNA, 801 bp, Artificial Sequence
  PD-L1 303 - CD80 2616
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagttatccacgtgaccaaggaagtgaaagaagtggcaacgctgtcctgtggtcacaatgtttctctggaagagctggcacaaactcgcatctactggcaaaagggtaagaaaatggtgctgactatgatgtctggggacatgaatatatggcccgagtacaagaaccggaccatctttgacatcactaataacctctccattgtgatcctggacccacgcccatctgacgagggcacatacgagtgtgttgttctgaagtatgaaaaagacgctttcaagcgggaacacctggctgaagtggattacaaggatgacgacgataagcaccatcatcaccatcactag

SEQ ID NO: 2639 - protein, 244 aa, Artificial Sequence
  PD-L1 303 - CD80 2616
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSVIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVDYKDDDDKHHHHHH

SEQ ID NO: 2640 - DNA, 801 bp, Artificial Sequence
  CD80 2616 - PD-L1 303
gccgccaccatggggtcaaccgccatcctcgccctcctcctggctgttctccaaggagtcagcgctgttatccacgtgaccaaggaagtgaaagaagtggcaacgctgtcctgtggtcacaatgtttctctggaagagctggcacaaactcgcatctactggcaaaagggtaagaaaatggtgctgactatgatgtctggggacatgaatatatggcccgagtacaagaaccggaccatctttgacatcactaataacctctccattgtgatcctggacccacgcccatctgacgagggcacatacgagtgtgttgttctgaagtatgaaaaagacgctttcaagcgggaacacctggctgaagtgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2641 - protein, 244 aa, Artificial Sequence
  CD80 2616 - PD-L1 303
VIHVTKEVKEVATLSCGHNVSLEELAQTRIYWQKGKKMVLTMMSGDMNIWPEYKNRTIFDITNNLSIVILDPRPSDEGTYECVVLKYEKDAFKREHLAEVGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2642 - DNA, 801 bp, Artificial Sequence
  PD-L1 303 - CD80 2617
gccgccaccatggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagttatccacgtgaccaaggaagtgaaagaagtggcaacgctgtcctgtggtcacaatgtttctgttgaagagctggcacaaactcgcatctactggcaaaagggtaagaaaatggtgctgactatgatgtctggggacatgaatatatggcccgagtacgaaaaccggaccatctttgacatcactaataacctctccattgtgatcctggacccacgcccatctgacgagggcacatacgagtgtgttgttctgaagtatgaaaaagacgctttcaagcgggaacacctggctgaagtggattacaaggatgacgacgataagcaccatcatcaccatcactag

SEQ ID NO: 2643 - protein, 244 aa, Artificial Sequence
  PD-L1 303 - CD80 2617
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSVIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVDYKDDDDKHHHHHH

SEQ ID NO: 2644 - DNA, 801 bp, Artificial Sequence
  CD80 2617 - PD-L1 303
gccgccaccatggggtcaaccgccatcctcgccctcctcctggctgttctccaaggagtcagcgctgttatccacgtgaccaaggaagtgaaagaagtggcaacgctgtcctgtggtcacaatgtttctgttgaagagctggcacaaactcgcatctactggcaaaagggtaagaaaatggtgctgactatgatgtctggggacatgaatatatggcccgagtacgaaaaccggaccatctttgacatcactaataacctctccattgtgatcctggacccacgcccatctgacgagggcacatacgagtgtgttgttctgaagtatgaaaaagacgctttcaagcgggaacacctggctgaagtgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2645 - protein, 244 aa, Artificial Sequence
  CD80 2617 - PD-L1 303
VIHVTKEVKEVATLSCGHNVSVEELAQTRIYWQKGKKMVLTMMSGDMNIWPEYENRTIFDITNNLSIVILDPRPSDEGTYECVVLKYEKDAFKREHLAEVGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2646 - DNA, 873 bp, Artificial Sequence
  CTLA-4 2520 - PD-L1 303
atggggtcaaccgccatcctcgccctcctcctggctgttctccaaggagtcagcgctaaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtctccagatagtgatcagggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcactag

SEQ ID NO: 2647 - protein, 271 aa, Artificial Sequence
  CTLA-4 2520 - PD-L1 303
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 2648 - DNA, 834 bp, Artificial Sequence
  CTLA-4 2520 - PD-L2 1417
atggggtcaaccgccatcctcgccctcctcctggctgttctccaaggagtcagcgctaaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtctccagatagtgatcagggatccggagggtctgggggaggcggttctgggggtggaggctcattattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctgattacaaggatgacgacgataagcaccatcatcaccatcactag

SEQ ID NO: 2649 - protein, 258 aa, Artificial Sequence
  CTLA-4 2520 - PD-L2 1417
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQGSGGSGGGGSGGGGSLFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKADYKDDDDKHHHHHH

SEQ ID NO: 2650 - DNA, 873 bp, Artificial Sequence
  PD-L1 303 - CTLA-4 2520
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcaaaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtctccagatagtgatcaggattacaaggatgacgacgataagcaccatcatcaccatcactag

SEQ ID NO: 2651 - protein, 271 aa, Artificial Sequence
  PD-L1 303 - CTLA-4 2520
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSKAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQDYKDDDDKHHHHHH

SEQ ID NO: 2652 - DNA, 843 bp, Artificial Sequence
  PD-L2 1417 - CTLA-4 2520
gccgccaccatggggtcaaccgccatcctcgccctcctcctggctgttctccaaggagtcagcgctttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcaaaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtctccagatagtgatcaggattacaaggatgacgacgataagcaccatcatcaccatcactag

SEQ ID NO: 2653 - protein, 258 aa, Artificial Sequence
  PD-L2 1417 - CTLA-4 2520
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSKAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSDQDYKDDDDKHHHHHH

SEQ ID NO: 2654 - protein, 100 aa, Homo sapiens
  MISC_FEATURE: CD80 WT IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEV

SEQ ID NO: 2655 - protein, 127 aa, Artificial Sequence
  CTLA-4 wild-type ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQ

SEQ ID NO: 2656 - protein, 208 aa, Artificial Sequence
  CD80 v196 ECD
VIHVTKEVKEVATLSCGHNVSVEELEQTRIYWRKDKKMVLTMMSGDLNIWPEYKNRTIFDITNNLSIVILALRPSDEGTYECVVQEYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2657 - protein, 208 aa, Artificial Sequence
  CD80 v197 ECD
VIHVTKEVKEVATLSCGHNVSVEELEQTRIYWRKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2658 - protein, 208 aa, Artificial Sequence
  CD80 v198 ECD
VIHVTKEVKEVATLSCGHNVSVEELAQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2659 - protein, 208 aa, Artificial Sequence
  CD80 v199 ECD
VIHVTKEVKEVATLSCGHNVSVEELEQTRIYWLKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2660 - protein, 208 aa, Artificial Sequence
  CD80 v200 ECD
VIHVTKEVKEVATLSCGHNVSVEELEQTRIYWLKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2661 - protein, 208 aa, Artificial Sequence
  CD80 v201 ECD
VIHVTKEVKEVATLSCGYNVSVEELEQTRIYWLKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2662 - protein, 208 aa, Artificial Sequence
  CD80 v202 ECD
VIHVTKEVKEVATLSCGHNVSVEELAQTRIYWLKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2663 - protein, 208 aa, Artificial Sequence
  CD80 v203 ECD
VIHVTKEVKEVATLSCGYNVSVEELAQTRIYWLKDKKMVLTMMSGDINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2664 - protein, 208 aa, Artificial Sequence
  CD80 v204 ECD
VIHVTKEVKEVATLSCGHNVSVEELAQTRIYWLKDKKMVLTMMSGEINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2665 - protein, 208 aa, Artificial Sequence
  CD80 v205 ECD
VIHVTKEVKEVATLSCGHNVSVEELAQTRIYWRKDKKMVLTMMSGEINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2666 - protein, 208 aa, Artificial Sequence
  CD80 v206 ECD
VIHVTKEVKEVATLSCGYNVSVEELAQTRIYWQKDKKMVLTMMSGDLNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2667 - protein, 208 aa, Artificial Sequence
  CD80 v207 ECD
VIHVTKEVKEVATLSCGHNVSVEELAQTRIYWLKDKKMVLTMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2668 - protein, 208 aa, Artificial Sequence
  CD80 v208 ECD
VIHVTKEVKEVATLSCGHNVSVEELAQTRIYWLKDKKMVLTMMSGDVNIWPEYKNRTIFDITNNLSIVILALRPSDEGAYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2669 - protein, 208 aa, Artificial Sequence
  CD80 v209 ECD
VIHVTKEVKEVATLSCGHNVSVEELAQTRIYWLKDKKMVLSMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2670 - protein, 208 aa, Artificial Sequence
  CD80 v210 ECD
VIHVTKEVKEVATLSCGHNVSVEELAQTRIYWLKDKKMVLTMMSGDINIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2671 - protein, 208 aa, Artificial Sequence
  CD80 v211 ECD
VIHVTKEVKEVATLSCGHNVSVEELAQTRIYWLKDKKMVLTMMSGDINIWPEYKNRTIFDINNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2672 - protein, 208 aa, Artificial Sequence
  CD80 v212 ECD
VIHVTKEVKEVATLSCGHNVSVEELAQTRIYWLKDKKMVLTMMSGDVNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2673 - protein, 208 aa, Artificial Sequence
  CD80 v213 ECD
VIHVTKEVKEVATLSCGHNVSVEELEQTRIYWQKDKKMVLTMTSGDLNIWPEYKNRTIFDITNNLSIVILALRPSDEGTYECVVQKYEKDAFKQEHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2674 - protein, 208 aa, Artificial Sequence
  CD80 v214 ECD
VIHVTKEVKEVATLSCGHNVSVEELAQTRIYWRKDKEMVLTMMSGDVNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2675 - protein, 208 aa, Artificial Sequence
  CD80 v215 ECD
VIHVTKEVKEVATLSCGHNVSADELAQTRIYWLKDKKMVLTMMSGDVNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2676 - protein, 208 aa, Artificial Sequence
  CD80 v216 ECD
VIHVTKEVKEVATLSCGHNVSVEDLAQTRIYWLKDKKMVLTMMSGDVNIWPEYRNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2677 - protein, 208 aa, Artificial Sequence
  CD80 v217 ECD
VIHVTKEVKEVATLPCGHNVSVEELAQTRIYWLKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2678 - protein, 208 aa, Artificial Sequence
  CD80 v218 ECD
VIHVTKDVKEVATLSCGHNVSVEELAQTRIYWQKDKKMVLTMMSGDINIWPEYKNRTIFDITNNLSIVILALRPSDEGTYECVVLKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2679 - protein, 208 aa, Artificial Sequence
  CD80 v219 ECD
VIHVTKEVKEVATLSCGHNVSVEELAQTRIYWLKDKKMVLSMISGDMNIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2680 - protein, 208 aa, Artificial Sequence
  CD80 v220 ECD
VIHVTKEVKEVATLSCGHNVSVEELAQTRIYWQKDKKMVLTMMSGDINIWPEYRNRTIFDITNNLSIVILALRPSDEGTYECVVEKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2681 - protein, 208 aa, Artificial Sequence
  CD80 v221 ECD
VIHVTKEVKEVATLSCGHNVSVEELAQTRIYWKKDKKMVLTMMSGVMNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2682 - protein, 208 aa, Artificial Sequence
  CD80 v222 ECD
VIHVTKEVKEVATLSCGHNVSVEELAQTRISWQKDKKMVLTMMSGDLNIWPEYKNRTIFDITNNLSIVILALRPSDEGLYECVVLKYGKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2683 - protein, 208 aa, Artificial Sequence
  CD80 v223 ECD
VIHVTKEVKEVATLSCGLNVSAEELAQTRIYWQKDKKMVLTMMSGDLTIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2684 - protein, 208 aa, Artificial Sequence
  CD80 v224 ECD
VIHVTKEVKEVATLSCGHNVSVEELAHTRIYWQKDKKMVLTMMSGDLNIWPEYKNRTIFDITNNLSIVILALRPSDEGTYECVVQKYEKDAFKQKHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2685 - protein, 208 aa, Artificial Sequence
  CD80 v225 ECD
VIHVTKEVKEVATLSCGHNVSVEELAQTRIYWKKDKKMVLTMMSGDVNIWPEYKNRTIFDITNNLSIVILALRPSDEGTYECVVLKYEEDAFRREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2686 - protein, 208 aa, Artificial Sequence
  CD80 v226 ECD
VIHVTKEVKEVATLSCGHNVSVEELAQTRIYWQKDKKMVLTMMSGDINIWPEYKNRTIFDITNNLSIVILALRPSDAGTYECVVQKYEKDAFKWEHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2687 - protein, 208 aa, Artificial Sequence
  CD80 v227 ECD
VIHVTKEVKEVATLSCGHNVSVEELEQTRIYWQKDKKMVLTMISGDLNIWPEYKNRTIFDITNNLSIVILALRPSDEGTYECVVQEYEKDAFKWEHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2688 - protein, 208 aa, Artificial Sequence
  CD80 v228 ECD
VIHVTKEVKEVATLSCGHNVSVEELAHTRIYWLKDKKMVLTMMSGDVNIWPEYKDRTIFDITNNLSIVILALRPSDEGTYECVVQKYENDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2689 - protein, 208 aa, Artificial Sequence
  CD80 v229 ECD
VIHVTKEVKEVATLSCGYNASVEELAQTRIYWLKDKKMVLTMMSGDVNIWPEFKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2690 - protein, 208 aa, Artificial Sequence
  CD80 v230 ECD
VIHVTKEVKEVATLSCGHNVSAEELAQTRIYWQKDKKMVLTMMSGDMNIWPEYKNRTIFDITNNLSIEILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2691 - protein, 208 aa, Artificial Sequence
  CD80 v231 ECD
VIHVTKEVKEVATLSCGHNVSVEELAQTRIYWLKDKKMVLTMMSGDLNIWPEYKNRTIFDITNNLSIVILGLRPSDEGTYECVVLKYEKDASKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2692 - protein, 208 aa, Artificial Sequence
  CD80 v232 ECD
VIHVTKEVKEVATLSCGHNVSAEELAQTHIYWQKDKKMVLTMMSGEINIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2693 - protein, 208 aa, Artificial Sequence
  CD80 v233 ECD
VIHVTKEVKEVATLSCGHNVSVEELAQTRIYWLKDKKMVLTMISGDMNIWPEYKNRTIFDITNNLSIVILALRPSDEGTYECVVQKYEKDAFKWEHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2694 - protein, 208 aa, Artificial Sequence
  CD80 v234 ECD
VIHVTKEVKEVATLSCGYNVSVEELAQTRIYWQKDKKMVLTMMSGDMNIWPEYKNRTIFDITNNLSIMILALRPSDEGTYECVVLKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2695 - protein, 208 aa, Artificial Sequence
  CD80 v235 ECD
VIHVTKEVKEVATLSCGHNVSVEELAQTRIYWLKDKKMVLTMMSGDLNIWPEYKNRTIFDITNNLSIMILALRPSDEGTYECVVQKYDKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2696 - protein, 208 aa, Artificial Sequence
  CD80 v236 ECD
VIHVTKEVKEVATLSCGHNVSVEELAQTRIYWLKDKKMVLTMVSGDINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2697 - protein, 208 aa, Artificial Sequence
  CD80 v237 ECD
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2698 - protein, 208 aa, Artificial Sequence
  CD80 v238 ECD
VIHVTKEVKEVATLSCGHNVSVEELAQTRIYWQKDKKMVLTMMSGDVNIWPEYKNRTIFDITNNLSIVILGLRPSDEGTYECVVMKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2699 - protein, 208 aa, Artificial Sequence
  CD80 v239 ECD
VIHVTKEVKEVATLSCGYNVSVEELAQTRIHWQKDKKMVLTMMSGDVNIWPEYKNRTIFDITNNLSIVILGLRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2700 - protein, 208 aa, Artificial Sequence
  CD80 v240 ECD
VIHVTKEVKEVATLSCGHNVSVEELAQTRIYWQKDKKMVLTMMSGEVNIWPEYKNRTIFDITNNLSIVILALRPSDEGTYECVVLKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2701 - protein, 208 aa, Artificial Sequence
  CD80 v241 ECD
VIHVTKEVKEVATLSCGHNVSVEELAQTRIYWQKDKKMVLTMMSGVINIWPEYKNRTIFDITNNLSIVILGLRPSDEGTYECVVLKYEKDAVKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2702 - protein, 208 aa, Artificial Sequence
  CD80 v242 ECD
VIHVTKEVKEVATLSCGHNVSVEELAQTRIYWQKDKKMVLTMMSGDVNIWPEYKNRTIFDIANNLSIVILGLRPSDEGTYECAVLKHEKDAFKREHMAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2703 - protein, 208 aa, Artificial Sequence
  CD80 v243 ECD
VIHVTKEVKEVATLSCGHNVSVEELAQTRIYWLKDKKMVLTMMSGDMKIWPEYKNRTIFDITNNLSIVILALRPSDEGTYECVVQKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2704 - protein, 208 aa, Artificial Sequence
  CD80 v244 ECD
VIHVTKEVKEVATLSCGHNVSVEELAQTRIYWQKDKKMVLTMMSGDMNIWPEYKNRTIFDITNNLSIVILALRPSDEGTYECVVQKYEKDAFTRVHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2705 - protein, 208 aa, Artificial Sequence
  CD80 v245 ECD
VIHVTKEVKEVATLSCGHNVSVEELAQTRIYWQKDKKMVLTMMSGDVKIWPEYKNRTIFDITNNLSIMILALRPSDEGTYECVVLKYENDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2706 - protein, 208 aa, Artificial Sequence
  CD80 v246 ECD
VIHVTKEVKEVATLSCGHNVSVEELAQTRIYWLKDKKMVLTMMSGDIDIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2707 - protein, 208 aa, Artificial Sequence
  CD80 v247 ECD
VIHVTKEVKEVATLSCGHNVSVEELAQTHIYWQKDKKMVLTMVSGDINVWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2708 - protein, 208 aa, Artificial Sequence
  CD80 v248 ECD
VIHVTKEVKEVATLSCGHNVSVEELAHTRIYWQKDKKMVLTMMSGDINIWPEYKNRTIFDITNNLSIVILALRPSDEGTYECVVQKYEKGAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2709 - protein, 208 aa, Artificial Sequence
  CD80 v249 ECD
VIHVTKEVKEVATLSCGHNVSVEELAQTRIYWQKDKKMVLTMMSGDINIWPEYKNRTIFDITNNLSIVILALRPSDEGTYECVVQKYEKGAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2710 - protein, 208 aa, Artificial Sequence
  CD80 v250 ECD
VIHVTKEVKEVATLSCGHNVSVEELAQTRIYWQKDKKMVLTMMSGDINIWPEYKNRTIFDISNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2711 - protein, 208 aa, Artificial Sequence
  CD80 v251 ECD
VIHVTKEVKEVATLSCGHNVSVEELEQTRIYWQKDKKMVLTMMSGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2712 - protein, 208 aa, Artificial Sequence
  CD80 v252 ECD
VIHVTKEVKEVATLSCGHNVSVEELAQTRIYWQKDKKMVLTMMSGDINIWPEYKNRTIFDITNNLSIVILALRPSDEGTYECVVLKQEEDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2713 - protein, 208 aa, Artificial Sequence
  CD80 v253 ECD
VIHVTKEVKEVATLSCGHNVSAEELAQTRIYWQKDKKMVLTMMSGDINIWPEYKNRTIFDITNNLSIVILALRPSDEGTYECVVLKNEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2714 - protein, 208 aa, Artificial Sequence
  CD80 v254 ECD
VIHVTKEVKEVATLSCGYNVSVEELEQTRIYWQKDKKMVLTMMSGDLNIWPEYKNRTIFDITNNLSIVILALRPSDEGTYECVVQKYEKGAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2715 - protein, 208 aa, Artificial Sequence
  CD80 v255 ECD
VIHVTKEVKEVATLSCGHNVSVEELAQTRIYWQKDKKMVLTMMSGDLNIWPEYKNRTIFDITNNLSIVILGLRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2716 - protein, 208 aa, Artificial Sequence
  CD80 v256 ECD
VIHVTKEVKEVATLSCGHNVSVEELAQTRIYWQKDKKMVLTMMSGDVNIWPEYKNRTIFDITNNLSIVILGLRPSDEGTYECVVLKYDKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2717 - protein, 208 aa, Artificial Sequence
  CD80 v257 ECD
VIHVTKEVKEVATLSCGHNVSVEELAQTRIYWQKDKKMVLTMMSGDMNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2718 - protein, 208 aa, Artificial Sequence
  CD80 v258 ECD
VIHVTKEVKEVATLSCGHNVSVEELAQTRIYWQKDKKMVLTMMSGDVNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2719 - protein, 208 aa, Artificial Sequence
  CD80 v259 ECD
VIHVTKEVKEVATLSCGHNVSVEELAQTRVYWQKDKKMVLTMMSGDVNIWPEYKNRTIFDITNNLSIVILGLRPSDEGTYECVVLKYEKDVFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2720 - protein, 208 aa, Artificial Sequence
  CD80 v260 ECD
VIHVTKEVKEVATLSCGHNVSVEELAQTRVCWQKDKKMVLTMMSGDVNIWPEYKNRTIFDITNNLSIVILGLRPSDEGTYECVVMKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2721 - protein, 208 aa, Artificial Sequence
  CD80 v261 ECD
VIHVTKEVKEVATLSCGHNVSDEELAQTRIYWQKDKKMVLTMMSGDLNIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2722 - protein, 208 aa, Artificial Sequence
  CD80 v262 ECD
VIHVTKEVKEVATLSCGYNVSVEELAQTRIYWQKDKKMVLTMMSGDMKIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2723 - protein, 208 aa, Artificial Sequence
  CD80 v263 ECD
VIHVTKEVKEVATLSCGHNVSVEELAQTRIYWQKDKKMVLSMMSGDVNIWPEYKNRTIFDITNNLSIVILGLRPSDEGTYECVVLKYENDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2724 - protein, 208 aa, Artificial Sequence
  CD80 v264 ECD
VIHVTKEVKEVATLSCGHNVSVEELAQTRIYWQKDKKMVLTMMSGDVTIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2725 - protein, 208 aa, Artificial Sequence
  CD80 v265 ECD
VIHVTKEVKEVATLSCGHNVSVEELAQTRIYWQKDKKMVLTMMSGEVNIWPEYKNRTIFDITNNLSIVILDLRPSDEGTYECVVLKYEKGAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2726 - protein, 208 aa, Artificial Sequence
  CD80 v266 ECD
VIHVTKEVKEVATLSCGHNVSVEELAQTRIYWQKDKKMVLTMMSGEVNIWPEYKNRTIFDITNNLSIVILDLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2727 - protein, 208 aa, Artificial Sequence
  CD80 v267 ECD
VIHVTKEVKEVATLSCGHNVSVEELAQTRIYWQKDKKMVLSMISGDMNIWPEYKNRTIFDITNNLSIVILGLRPSDEGTYECVVLKYEKGAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2728 - protein, 208 aa, Artificial Sequence
  CD80 v268 ECD
VIHVTKEVKEVATLSCGHNVSVEELAQTRIYWQKDKKMVLSMISGDVNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2729 - protein, 208 aa, Artificial Sequence
  CD80 v269 ECD
VIHVTKEVKEVATLSCGHNVSVEELAQTRIYWQKDKKMVLSMISGDLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2730 - protein, 208 aa, Artificial Sequence
  CD80 v270 ECD
VIHVTKEVKEVATLSCGYNVSAEELAQTRIYWQKDKKMVLTMMSGDVNIWPEYKNRTIFDISNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2731 - protein, 208 aa, Artificial Sequence
  CD80 v271 ECD
VIHVTKEVKEVATLSCGYNVSVEELEQTRIYWQKDKKMVLTMMSGDLNIWPEYKNRTIFDITNNLSIMILGLRPSDEGTYECVVLKYEKGAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2732 - protein, 208 aa, Artificial Sequence
  CD80 v272 ECD
VIHVTKEVKEVATLSCGHNVSVEELAQTRIYWQKDKEMVLTMMSGDVDIWPEYKNRTIFDITNNLSIVILALRPSDEGTYECVVQKYEKNAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2733 - protein, 208 aa, Artificial Sequence
  CD80 v273 ECD
VIHVTKEVKEVATLSCGHNVSVEELAHTRIYWQKDKKMVLTMMSGVLNIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2734 - protein, 208 aa, Artificial Sequence
  CD80 v274 ECD
VIHVTKEVKEVATLSCGHNVSLEELAHTRIYWQKDKKMVLTMMSGDINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2735 - protein, 208 aa, Artificial Sequence
  CD80 v275 ECD
VIHVTKEVKEVATLSCGHNVSVEELAQTRIYWQKDKKMVLTMMSGVLNIWPEYKNRTIFDITNNLSIMILALRPSDEGTYECVVQKYDKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2736 - protein, 208 aa, Artificial Sequence
  CD80 v276 ECD
VIHVTKEVKEVATLSCGHNVSVEELAQTRIYWQKDKKMVLSMVSGDINIWPEYKNRTIFDITNNLSIVIMGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2737 - protein, 208 aa, Artificial Sequence
  CD80 v277 ECD
VIHVTKEVKEVATLSCGHNVSVEELAQTRIYWQKDKKMVLTMMSGEVNIWPEYKNRTIFDITDNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2738 - protein, 208 aa, Artificial Sequence
  CD80 v278 ECD
VIHVTKEVKEVATLSCGHNVSVEELAQTRIYWQKDKKMVLTMMSGDVNIWPEYKNRTIFDIANNLSIVILDLRPSDEGTYECVVLKYEKDAFEREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2739 - protein, 208 aa, Artificial Sequence
  CD80 v279 ECD
VIHVTKEVKEVATLSCGHNVSVEELAQTRIYWQKDKKMVLTMMSGEVNIWPEYKNRTIFDITNNLSIMILALRPSDEGTYECVVLKYEKGAFEREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2740 - protein, 208 aa, Artificial Sequence
  CD80 v280 ECD
VIHVTKEVKEVATLSCGHNVSVEELAQTRIYWQKDKKMVLTMISGDVNIWPEYKNRTIFDITNNLSIVILALRPSDEGTYECVVLKYENDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2741 - protein, 208 aa, Artificial Sequence
  CD80 v281 ECD
VIHVTKEVKEVATLSCGHNVSVEELAQTRIYWQKDKKMVLTMMSGDLNIWPEYKNRTIFDITNNLSIVILGLRPSDEGTYECVVMKYEKDAYKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2742 - protein, 208 aa, Artificial Sequence
  CD80 v282 ECD
VIHVTKEVKEVATLSCGHNVSVEELAQTRIYWQKDKKMVLTVMSGDVNIWPDYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2743 - protein, 208 aa, Artificial Sequence
  CD80 v283 ECD
VIHVTKEVKEVATLSCGHNVSDEELAQTRIYWQKDKKMVLTMMSGDLNIWPEYKNRTIFDITNNLSIVIMALRPSDEGTYECVVLKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2744 - protein, 208 aa, Artificial Sequence
  CD80 v284 ECD
VIHVTKEVKEVATLSCGHNVSVEELAQTRIYWQKDKKMVLSMMSGDVNIWPEYKNRTIFDITNNLSIVILALRPSDEGTYECVVLKYEKDAFKREHQAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2745 - protein, 208 aa, Artificial Sequence
  CD80 v285 ECD
VIHVTKEVKEVATLSCGHNVSVEELAQTRIYWQKDKKMVLTMMSGDMNIWPEHKNRTIFDITNNLSIVILGLRPSDEGTYECVVLKYEKGAFKREHRAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2746 - protein, 208 aa, Artificial Sequence
  CD80 v286 ECD
VIHVTKEVKEVATLSCGHNVSVEELAQTRIYWQKDKKMVLTMMSGDMNIWPEYKNRTIFDITNNLSIVILDVHPSDEGTYKCVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2747 - protein, 208 aa, Artificial Sequence
  CD80 v287 ECD
VIHVTKEVKEVATLSCGHNVSVEELAQTRIYWLKDKKMVLTMISGDMNIWPEFKNRTIFDISNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2748 - protein, 208 aa, Artificial Sequence
  CD80 v288 ECD
VIHVTKEVKEVATLSCGHNVSVEELAQTRIYWQKDKKTVLTMMSGEVSIWPEYKNRTIFDITNNLSIVILALRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2749 - protein, 208 aa, Artificial Sequence
  CD80 v289 ECD
VIHVTKEVKEVATLSCGHNVSVEELAQTRIYWRKDKKMVLTMMSGDVKIWPEYKNRTIFDITNNLSIVILALRPSDEGTYECVVMKYEKDALKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2750 - protein, 208 aa, Artificial Sequence
  CD80 v290 ECD
VIHVTKEVKEVATLSCGHNVSVEELAQTRIYWQKDKKTVLTMVSGDVRIWPEYKNRTIFDITNNLSIVILALRPSDEGTYECVVQKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2751 - protein, 208 aa, Artificial Sequence
  CD80 v291 ECD
VIHVTKEVKEVATLSCGHNVSVEELAQYRIYWHKDKKMVLTMMSGVINIWPEYKNRTIFDITNNLSIVILGLRPSDEGTYECVVLKYEKDAFKREHLAEVTLSVKADFPTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 2752 - protein, 101 aa, Artificial Sequence
  CD80 v196 IgV
VIHVTKEVKEVATLSCGHNVSVEELEQTRIYWRKDKKMVLTMMSGDLNIWPEYKNRTIFDITNNLSIVILALRPSDEGTYECVVQEYEKDAFKREHLAEVT

SEQ ID NO: 2753 - protein, 101 aa, Artificial Sequence
  CD80 v197 IgV
VIHVTKEVKEVATLSCGHNVSVEELEQTRIYWRKDKKMVLTMMSGDLNIWPEYKNRTIFDITNNLSIVILALRPSDEGTYECVVQKYEKDAFKREHLAEVT

SEQ ID NO: 2754 - protein, 101 aa, Artificial Sequence
  CD80 v198 IgV
VIHVTKEVKEVATLSCGHNVSVEELAQTRIYWQKDKKMVLTMMSGDLNIWPEYKNRTIFDITNNLSIVILALRPSDEGTYECVVQKYEKDAFKREHLAEVT

SEQ ID NO: 2755 - protein, 101 aa, Artificial Sequence
  CD80 v199 IgV
VIHVTKEVKEVATLSCGHNVSVEELEQTRIYWLKDKKMVLTMMSGDLNIWPEYKNRTIFDITNNLSIVILALRPSDEGTYECVVQKYEKDAFKREHLAEVT

SEQ ID NO: 2756 - protein, 101 aa, Artificial Sequence
  CD80 v200 IgV
VIHVTKEVKEVATLSCGHNVSVEELEQTRIYWLKDKKMVLTMMSGDLNIWPEYKNRTIFDITNNLSIVILALRPSDEGTYECVVLKYEKDAFKREHLAEVT

SEQ ID NO: 2757 - protein, 101 aa, Artificial Sequence
  CD80 v201 IgV
VIHVTKEVKEVATLSCGYNVSVEELEQTRIYWLKDKKMVLTMMSGDLNIWPEYKNRTIFDITNNLSIVILALRPSDEGTYECVVQKYEKDAFKREHLAEVT

SEQ ID NO: 2758 - protein, 101 aa, Artificial Sequence
  CD80 v202 IgV
VIHVTKEVKEVATLSCGHNVSVEELAQTRIYWLKDKKMVLTMMSGDINIWPEYKNRTIFDITNNLSIVILALRPSDEGTYECVVLKYEKDAFKREHLAEVT

SEQ ID NO: 2759 - protein, 101 aa, Artificial Sequence
  CD80 v203 IgV
VIHVTKEVKEVATLSCGYNVSVEELAQTRIYWLKDKKMVLTMMSGDINIWPEYKNRTIFDITNNLSIVILALRPSDEGTYECVVLKYEKDAFKREHLAEVT

SEQ ID NO: 2760 - protein, 101 aa, Artificial Sequence
  CD80 v204 IgV
VIHVTKEVKEVATLSCGHNVSVEELAQTRIYWLKDKKMVLTMMSGEINIWPEYKNRTIFDITNNLSIVILALRPSDEGTYECVVLKYEKDAFKREHLAEVT

SEQ ID NO: 2761 - protein, 101 aa, Artificial Sequence
  CD80 v205 IgV
VIHVTKEVKEVATLSCGHNVSVEELAQTRIYWRKDKKMVLTMMSGEINIWPEYKNRTIFDITNNLSIVILALRPSDEGTYECVVLKYEKDAFKREHLAEVT

SEQ ID NO: 2762 - protein, 101 aa, Artificial Sequence
  CD80 v206 IgV
VIHVTKEVKEVATLSCGYNVSVEELAQTRIYWQKDKKMVLTMMSGDLNIWPEYKNRTIFDITNNLSIVILALRPSDEGTYECVVLKYEKDAFKREHLAEVT

SEQ ID NO: 2763 - protein, 101 aa, Artificial Sequence
  CD80 v207 IgV
VIHVTKEVKEVATLSCGHNVSVEELAQTRIYWLKDKKMVLTMMSGDVNIWPEYKNRTIFDITNNLSIVILALRPSDEGTYECVVLKYEKDAFKREHLAEVT

SEQ ID NO: 2764 - protein, 101 aa, Artificial Sequence
  CD80 v208 IgV
VIHVTKEVKEVATLSCGHNVSVEELAQTRIYWLKDKKMVLTMMSGDVNIWPEYKNRTIFDITNNLSIVILALRPSDEGAYECVVLKYEKDAFKREHLAEVT

SEQ ID NO: 2765 - protein, 101 aa, Artificial Sequence
  CD80 v209 IgV
VIHVTKEVKEVATLSCGHNVSVEELAQTRIYWLKDKKMVLSMMSGDVNIWPEYKNRTIFDITNNLSIVILALRPSDEGTYECVVLKYEKDAFKREHLAEVT

SEQ ID NO: 2766 - protein, 101 aa, Artificial Sequence
  CD80 v210 IgV
VIHVTKEVKEVATLSCGHNVSVEELAQTRIYWLKDKKMVLTMMSGDINIWPEYKNRTIFDITNNLSIVILALRPSDEGTYECVVQKYEKDAFKREHLAEVT

SEQ ID NO: 2767 - protein, 101 aa, Artificial Sequence
  CD80 v211 IgV
VIHVTKEVKEVATLSCGHNVSVEELAQTRIYWLKDKKMVLTMMSGDINIWPEYKNRTIFDINNNLSIVILALRPSDEGTYECVVQKYEKDAFKREHLAEVT

SEQ ID NO: 2768 - protein, 101 aa, Artificial Sequence
  CD80 v212 IgV
VIHVTKEVKEVATLSCGHNVSVEELAQTRIYWLKDKKMVLTMMSGDVNIWPEYKNRTIFDITNNLSIVILALRPSDEGTYECVVQKYEKDAFKREHLAEVT

SEQ ID NO: 2769 - protein, 101 aa, Artificial Sequence
  CD80 v213 IgV
VIHVTKEVKEVATLSCGHNVSVEELEQTRIYWQKDKKMVLTMTSGDLNIWPEYKNRTIFDITNNLSIVILALRPSDEGTYECVVQKYEKDAFKQEHLAEVT

SEQ ID NO: 2770 - protein, 101 aa, Artificial Sequence
  CD80 v214 IgV
VIHVTKEVKEVATLSCGHNVSVEELAQTRIYWRKDKEMVLTMMSGDVNIWPEYKNRTIFDITNNLSIVILALRPSDEGTYECVVQKYEKDAFKREHLAEVT

SEQ ID NO: 2771 - protein, 101 aa, Artificial Sequence
  CD80 v215 IgV
VIHVTKEVKEVATLSCGHNVSADELAQTRIYWLKDKKMVLTMMSGDVNIWPEYKNRTIFDITNNLSIVILALRPSDEGTYECVVLKYEKDAFKREHLAEVT

SEQ ID NO: 2772 - protein, 101 aa, Artificial Sequence
  CD80 v216 IgV
VIHVTKEVKEVATLSCGHNVSVEDLAQTRIYWLKDKKMVLTMMSGDVNIWPEYRNRTIFDITNNLSIVILALRPSDEGTYECVVQKYEKDAFKREHLAEVT

SEQ ID NO: 2773 - protein, 101 aa, Artificial Sequence
  CD80 v217 IgV
VIHVTKEVKEVATLPCGHNVSVEELAQTRIYWLKDKKMVLTMMSGDLNIWPEYKNRTIFDITNNLSIVILALRPSDEGTYECVVQKYEKDAFKREHLAEVT

SEQ ID NO: 2774 - protein, 101 aa, Artificial Sequence
  CD80 v218 IgV
VIHVTKDVKEVATLSCGHNVSVEELAQTRIYWQKDKKMVLTMMSGDINIWPEYKNRTIFDITNNLSIVILALRPSDEGTYECVVLKYEKDAFKREHQAEVT

SEQ ID NO: 2775 - protein, 101 aa, Artificial Sequence
  CD80 v219 IgV
VIHVTKEVKEVATLSCGHNVSVEELAQTRIYWLKDKKMVLSMISGDMNIWPEYKNRTIFDITNNLSIVILALRPSDEGTYECVVLKYEKDAFKREHLAEVT

SEQ ID NO: 2776 - protein, 101 aa, Artificial Sequence
  CD80 v220 IgV
VIHVTKEVKEVATLSCGHNVSVEELAQTRIYWQKDKKMVLTMMSGDINIWPEYRNRTIFDITNNLSIVILALRPSDEGTYECVVEKYEKDAFKREHLAEVT

SEQ ID NO: 2777 - protein, 101 aa, Artificial Sequence
  CD80 v221 IgV
VIHVTKEVKEVATLSCGHNVSVEELAQTRIYWKKDKKMVLTMMSGVMNIWPEYKNRTIFDITNNLSIVILALRPSDEGTYECVVQKYEKDAFKREHLAEVT

SEQ ID NO: 2778 - protein, 101 aa, Artificial Sequence
  CD80 v222 IgV
VIHVTKEVKEVATLSCGHNVSVEELAQTRISWQKDKKMVLTMMSGDLNIWPEYKNRTIFDITNNLSIVILALRPSDEGLYECVVLKYGKDAFKREHLAEVT

SEQ ID NO: 2779 - protein, 101 aa, Artificial Sequence
  CD80 v223 IgV
VIHVTKEVKEVATLSCGLNVSAEELAQTRIYWQKDKKMVLTMMSGDLTIWPEYKNRTIFDITNNLSIVILALRPSDEGTYECVVQKYEKDAFKREHLAEVT

SEQ ID NO: 2780 - protein, 101 aa, Artificial Sequence
  CD80 v224 IgV
VIHVTKEVKEVATLSCGHNVSVEELAHTRIYWQKDKKMVLTMMSGDLNIWPEYKNRTIFDITNNLSIVILALRPSDEGTYECVVQKYEKDAFKQKHLAEVT

SEQ ID NO: 2781 - protein, 101 aa, Artificial Sequence
  CD80 v225 IgV
VIHVTKEVKEVATLSCGHNVSVEELAQTRIYWKKDKKMVLTMMSGDVNIWPEYKNRTIFDITNNLSIVILALRPSDEGTYECVVLKYEEDAFRREHLAEVT

SEQ ID NO: 2782 - protein, 101 aa, Artificial Sequence
  CD80 v226 IgV
VIHVTKEVKEVATLSCGHNVSVEELAQTRIYWQKDKKMVLTMMSGDINIWPEYKNRTIFDITNNLSIVILALRPSDAGTYECVVQKYEKDAFKWEHLAEVT

SEQ ID NO: 2783 - protein, 101 aa, Artificial Sequence
  CD80 v227 IgV
VIHVTKEVKEVATLSCGHNVSVEELEQTRIYWQKDKKMVLTMISGDLNIWPEYKNRTIFDITNNLSIVILALRPSDEGTYECVVQEYEKDAFKWEHLAEVT

SEQ ID NO: 2784 - protein, 101 aa, Artificial Sequence
  CD80 v228 IgV
VIHVTKEVKEVATLSCGHNVSVEELAHTRIYWLKDKKMVLTMMSGDVNIWPEYKDRTIFDITNNLSIVILALRPSDEGTYECVVQKYENDAFKREHLAEVT

SEQ ID NO: 2785 - protein, 101 aa, Artificial Sequence
  CD80 v229 IgV
VIHVTKEVKEVATLSCGYNASVEELAQTRIYWLKDKKMVLTMMSGDVNIWPEFKNRTIFDITNNLSIVILALRPSDEGTYECVVLKYEKDAFKREHLAEVT

SEQ ID NO: 2786 - protein, 101 aa, Artificial Sequence
  CD80 v230 IgV
VIHVTKEVKEVATLSCGHNVSAEELAQTRIYWQKDKKMVLTMMSGDMNIWPEYKNRTIFDITNNLSIEILDLRPSDEGTYECVVLKYEKDAFKREHLAEVT

SEQ ID NO: 2787 - protein, 101 aa, Artificial Sequence
  CD80 v231 IgV
VIHVTKEVKEVATLSCGHNVSVEELAQTRIYWLKDKKMVLTMMSGDLNIWPEYKNRTIFDITNNLSIVILGLRPSDEGTYECVVLKYEKDASKREHLAEVT

SEQ ID NO: 2788 - protein, 101 aa, Artificial Sequence
  CD80 v232 IgV
VIHVTKEVKEVATLSCGHNVSAEELAQTHIYWQKDKKMVLTMMSGEINIWPEYKNRTIFDITNNLSIVILALRPSDEGTYECVVLKYEKDAFKREHLAEVT

SEQ ID NO: 2789 - protein, 101 aa, Artificial Sequence
  CD80 v233 IgV
VIHVTKEVKEVATLSCGHNVSVEELAQTRIYWLKDKKMVLTMISGDMNIWPEYKNRTIFDITNNLSIVILALRPSDEGTYECVVQKYEKDAFKWEHLAEVT

SEQ ID NO: 2790 - protein, 101 aa, Artificial Sequence
  CD80 v234 IgV
VIHVTKEVKEVATLSCGYNVSVEELAQTRIYWQKDKKMVLTMMSGDMNIWPEYKNRTIFDITNNLSIMILALRPSDEGTYECVVLKYEKDAFKREHQAEVT

SEQ ID NO: 2791 - protein, 101 aa, Artificial Sequence
  CD80 v235 IgV
VIHVTKEVKEVATLSCGHNVSVEELAQTRIYWLKDKKMVLTMMSGDLNIWPEYKNRTIFDITNNLSIMILALRPSDEGTYECVVQKYDKDAFKREHLAEVT

SEQ ID NO: 2792 - protein, 101 aa, Artificial Sequence
  CD80 v236 IgV
VIHVTKEVKEVATLSCGHNVSVEELAQTRIYWLKDKKMVLTMVSGDINIWPEYKNRTIFDITNNLSIVILGLRPSDEGTYECVVLKYEKDAFKREHLAEVT

SEQ ID NO: 2793 - protein, 101 aa, Artificial Sequence
  CD80 v237 IgV
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHQAEVT

SEQ ID NO: 2794 - protein, 101 aa, Artificial Sequence
  CD80 v238 IgV
VIHVTKEVKEVATLSCGHNVSVEELAQTRIYWQKDKKMVLTMMSGDVNIWPEYKNRTIFDITNNLSIVILGLRPSDEGTYECVVMKYEKDAFKREHQAEVT

SEQ ID NO: 2795 - protein, 101 aa, Artificial Sequence
  CD80 v239 IgV
VIHVTKEVKEVATLSCGYNVSVEELAQTRIHWQKDKKMVLTMMSGDVNIWPEYKNRTIFDITNNLSIVILGLRPSDEGTYECVVQKYEKDAFKREHLAEVT

SEQ ID NO: 2796 - protein, 101 aa, Artificial Sequence
  CD80 v240 IgV
VIHVTKEVKEVATLSCGHNVSVEELAQTRIYWQKDKKMVLTMMSGEVNIWPEYKNRTIFDITNNLSIVILALRPSDEGTYECVVLKYEKDAFKREHQAEVT

SEQ ID NO: 2797 - protein, 101 aa, Artificial Sequence
  CD80 v241 IgV
VIHVTKEVKEVATLSCGHNVSVEELAQTRIYWQKDKKMVLTMMSGVINIWPEYKNRTIFDITNNLSIVILGLRPSDEGTYECVVLKYEKDAVKREHLAEVT

SEQ ID NO: 2798 - protein, 101 aa, Artificial Sequence
  CD80 v242 IgV
VIHVTKEVKEVATLSCGHNVSVEELAQTRIYWQKDKKMVLTMMSGDVNIWPEYKNRTIFDIANNLSIVILGLRPSDEGTYECAVLKHEKDAFKREHMAEVT

SEQ ID NO: 2799 - protein, 101 aa, Artificial Sequence
  CD80 v243 IgV
VIHVTKEVKEVATLSCGHNVSVEELAQTRIYWLKDKKMVLTMMSGDMKIWPEYKNRTIFDITNNLSIVILALRPSDEGTYECVVQKYEKDAFKREHQAEVT

SEQ ID NO: 2800 - protein, 101 aa, Artificial Sequence
  CD80 v244 IgV
VIHVTKEVKEVATLSCGHNVSVEELAQTRIYWQKDKKMVLTMMSGDMNIWPEYKNRTIFDITNNLSIVILALRPSDEGTYECVVQKYEKDAFTRVHQAEVT

SEQ ID NO: 2801 - protein, 101 aa, Artificial Sequence
  CD80 v245 IgV
VIHVTKEVKEVATLSCGHNVSVEELAQTRIYWQKDKKMVLTMMSGDVKIWPEYKNRTIFDITNNLSIMILALRPSDEGTYECVVLKYENDAFKREHLAEVT

SEQ ID NO: 2802 - protein, 101 aa, Artificial Sequence
  CD80 v246 IgV
VIHVTKEVKEVATLSCGHNVSVEELAQTRIYWLKDKKMVLTMMSGDIDIWPEYKNRTIFDITNNLSIVILGLRPSDEGTYECVVLKYEKDAFKREHLAEVT

SEQ ID NO: 2803 - protein, 101 aa, Artificial Sequence
  CD80 v247 IgV
VIHVTKEVKEVATLSCGHNVSVEELAQTHIYWQKDKKMVLTMVSGDINVWPEYKNRTIFDITNNLSIVILALRPSDEGTYECVVLKYEKDAFKREHLAEVT

SEQ ID NO: 2804 - protein, 101 aa, Artificial Sequence
  CD80 v248 IgV
VIHVTKEVKEVATLSCGHNVSVEELAHTRIYWQKDKKMVLTMMSGDINIWPEYKNRTIFDITNNLSIVILALRPSDEGTYECVVQKYEKGAFKREHLAEVT

SEQ ID NO: 2805 - protein, 101 aa, Artificial Sequence
  CD80 v249 IgV
VIHVTKEVKEVATLSCGHNVSVEELAQTRIYWQKDKKMVLTMMSGDINIWPEYKNRTIFDITNNLSIVILALRPSDEGTYECVVQKYEKGAFKREHLAEVT

SEQ ID NO: 2806 - protein, 101 aa, Artificial Sequence
  CD80 v250 IgV
VIHVTKEVKEVATLSCGHNVSVEELAQTRIYWQKDKKMVLTMMSGDINIWPEYKNRTIFDISNNLSIVILALRPSDEGTYECVVQKYEKDAFKREHLAEVT

SEQ ID NO: 2807 - protein, 101 aa, Artificial Sequence
  CD80 v251 IgV
VIHVTKEVKEVATLSCGHNVSVEELEQTRIYWQKDKKMVLTMMSGDLNIWPEYKNRTIFDITNNLSIVILGLRPSDEGTYECVVLKYEKDAFKREHLAEVT

SEQ ID NO: 2808 - protein, 101 aa, Artificial Sequence
  CD80 v252 IgV
VIHVTKEVKEVATLSCGHNVSVEELAQTRIYWQKDKKMVLTMMSGDINIWPEYKNRTIFDITNNLSIVILALRPSDEGTYECVVLKQEEDAFKREHLAEVT

SEQ ID NO: 2809 - protein, 101 aa, Artificial Sequence
  CD80 v253 IgV
VIHVTKEVKEVATLSCGHNVSAEELAQTRIYWQKDKKMVLTMMSGDINIWPEYKNRTIFDITNNLSIVILALRPSDEGTYECVVLKNEKDAFKREHLAEVT

SEQ ID NO: 2810 - protein, 101 aa, Artificial Sequence
  CD80 v254 IgV
VIHVTKEVKEVATLSCGYNVSVEELEQTRIYWQKDKKMVLTMMSGDLNIWPEYKNRTIFDITNNLSIVILALRPSDEGTYECVVQKYEKGAFKREHLAEVT

SEQ ID NO: 2811 - protein, 101 aa, Artificial Sequence
  CD80 v255 IgV
VIHVTKEVKEVATLSCGHNVSVEELAQTRIYWQKDKKMVLTMMSGDLNIWPEYKNRTIFDITNNLSIVILGLRPSDEGTYECVVQKYEKDAFKREHLAEVT

SEQ ID NO: 2812 - protein, 101 aa, Artificial Sequence
  CD80 v256 IgV
VIHVTKEVKEVATLSCGHNVSVEELAQTRIYWQKDKKMVLTMMSGDVNIWPEYKNRTIFDITNNLSIVILGLRPSDEGTYECVVLKYDKDAFKREHLAEVT

SEQ ID NO: 2813 - protein, 101 aa, Artificial Sequence
  CD80 v257 IgV
VIHVTKEVKEVATLSCGHNVSVEELAQTRIYWQKDKKMVLTMMSGDMNIWPEYKNRTIFDITNNLSIVILGLRPSDEGTYECVVLKYEKDAFKREHLAEVT

SEQ ID NO: 2814 - protein, 101 aa, Artificial Sequence
  CD80 v258 IgV
VIHVTKEVKEVATLSCGHNVSVEELAQTRIYWQKDKKMVLTMMSGDVNIWPEYKNRTIFDITNNLSIVILGLRPSDEGTYECVVLKYEKDAFKREHLAEVT

SEQ ID NO: 2815 - protein, 101 aa, Artificial Sequence
  CD80 v259 IgV
VIHVTKEVKEVATLSCGHNVSVEELAQTRVYWQKDKKMVLTMMSGDVNIWPEYKNRTIFDITNNLSIVILGLRPSDEGTYECVVLKYEKDVFKREHLAEVT

SEQ ID NO: 2816 - protein, 101 aa, Artificial Sequence
  CD80 v260 IgV
VIHVTKEVKEVATLSCGHNVSVEELAQTRVCWQKDKKMVLTMMSGDVNIWPEYKNRTIFDITNNLSIVILGLRPSDEGTYECVVMKYEKDAFKREHLAEVT

SEQ ID NO: 2817 - protein, 101 aa, Artificial Sequence
  CD80 v261 IgV
VIHVTKEVKEVATLSCGHNVSDEELAQTRIYWQKDKKMVLTMMSGDLNIWPEYKNRTIFDITNNLSIVILALRPSDEGTYECVVQKYEKDAFKREHLAEVT

SEQ ID NO: 2818 - protein, 101 aa, Artificial Sequence
  CD80 v262 IgV
VIHVTKEVKEVATLSCGYNVSVEELAQTRIYWQKDKKMVLTMMSGDMKIWPEYKNRTIFDITNNLSIVILALRPSDEGTYECVVLKYEKDAFKREHLAEVT

SEQ ID NO: 2819 - protein, 101 aa, Artificial Sequence
  CD80 v263 IgV
VIHVTKEVKEVATLSCGHNVSVEELAQTRIYWQKDKKMVLSMMSGDVNIWPEYKNRTIFDITNNLSIVILGLRPSDEGTYECVVLKYENDAFKREHLAEVT

SEQ ID NO: 2820 - protein, 101 aa, Artificial Sequence
  CD80 v264 IgV
VIHVTKEVKEVATLSCGHNVSVEELAQTRIYWQKDKKMVLTMMSGDVTIWPEYKNRTIFDITNNLSIVILALRPSDEGTYECVVQKYEKDAFKREHLAEVT

SEQ ID NO: 2821 - protein, 101 aa, Artificial Sequence
  CD80 v265 IgV
VIHVTKEVKEVATLSCGHNVSVEELAQTRIYWQKDKKMVLTMMSGEVNIWPEYKNRTIFDITNNLSIVILDLRPSDEGTYECVVLKYEKGAFKREHLAEVT

SEQ ID NO: 2822 - protein, 101 aa, Artificial Sequence
  CD80 v266 IgV
VIHVTKEVKEVATLSCGHNVSVEELAQTRIYWQKDKKMVLTMMSGEVNIWPEYKNRTIFDITNNLSIVILDLRPSDEGTYECVVLKYEKDAFKREHLAEVT

SEQ ID NO: 2823 - protein, 101 aa, Artificial Sequence
  CD80 v267 IgV
VIHVTKEVKEVATLSCGHNVSVEELAQTRIYWQKDKKMVLSMISGDMNIWPEYKNRTIFDITNNLSIVILGLRPSDEGTYECVVLKYEKGAFKREHLAEVT

SEQ ID NO: 2824 - protein, 101 aa, Artificial Sequence
  CD80 v268 IgV
VIHVTKEVKEVATLSCGHNVSVEELAQTRIYWQKDKKMVLSMISGDVNIWPEYKNRTIFDITNNLSIVILGLRPSDEGTYECVVLKYEKDAFKREHLAEVT

SEQ ID NO: 2825 - protein, 101 aa, Artificial Sequence
  CD80 v269 IgV
VIHVTKEVKEVATLSCGHNVSVEELAQTRIYWQKDKKMVLSMISGDLNIWPEYKNRTIFDITNNLSIVILGLRPSDEGTYECVVLKYEKDAFKREHLAEVT

SEQ ID NO: 2826 - protein, 101 aa, Artificial Sequence
  CD80 v270 IgV
VIHVTKEVKEVATLSCGYNVSAEELAQTRIYWQKDKKMVLTMMSGDVNIWPEYKNRTIFDISNNLSIVILGLRPSDEGTYECVVLKYEKDAFKREHLAEVT

SEQ ID NO: 2827 - protein, 101 aa, Artificial Sequence
  CD80 v271 IgV
VIHVTKEVKEVATLSCGYNVSVEELEQTRIYWQKDKKMVLTMMSGDLNIWPEYKNRTIFDITNNLSIMILGLRPSDEGTYECVVLKYEKGAFKREHLAEVT

SEQ ID NO: 2828 - protein, 101 aa, Artificial Sequence
  CD80 v272 IgV
VIHVTKEVKEVATLSCGHNVSVEELAQTRIYWQKDKEMVLTMMSGDVDIWPEYKNRTIFDITNNLSIVILALRPSDEGTYECVVQKYEKNAFKREHLAEVT

SEQ ID NO: 2829 - protein, 101 aa, Artificial Sequence
  CD80 v273 IgV
VIHVTKEVKEVATLSCGHNVSVEELAHTRIYWQKDKKMVLTMMSGVLNIWPEYKNRTIFDITNNLSIVILGLRPSDEGTYECVVLKYEKDAFKREHLAEVT

SEQ ID NO: 2830 - protein, 101 aa, Artificial Sequence
  CD80 v274 IgV
VIHVTKEVKEVATLSCGHNVSLEELAHTRIYWQKDKKMVLTMMSGDINIWPEYKNRTIFDITNNLSIVILGLRPSDEGTYECVVLKYEKDAFKREHLAEVT

SEQ ID NO: 2831 - protein, 101 aa, Artificial Sequence
  CD80 v275 IgV
VIHVTKEVKEVATLSCGHNVSVEELAQTRIYWQKDKKMVLTMMSGVLNIWPEYKNRTIFDITNNLSIMILALRPSDEGTYECVVQKYDKDAFKREHLAEVT

SEQ ID NO: 2832 - protein, 101 aa, Artificial Sequence
  CD80 v276 IgV
VIHVTKEVKEVATLSCGHNVSVEELAQTRIYWQKDKKMVLSMVSGDINIWPEYKNRTIFDITNNLSIVIMGLRPSDEGTYECVVLKYEKDAFKREHLAEVT

SEQ ID NO: 2833 - protein, 101 aa, Artificial Sequence
  CD80 v277 IgV
VIHVTKEVKEVATLSCGHNVSVEELAQTRIYWQKDKKMVLTMMSGEVNIWPEYKNRTIFDITDNLSIVILALRPSDEGTYECVVQKYEKDAFKREHLAEVT

SEQ ID NO: 2834 - protein, 101 aa, Artificial Sequence
  CD80 v278 IgV
VIHVTKEVKEVATLSCGHNVSVEELAQTRIYWQKDKKMVLTMMSGDVNIWPEYKNRTIFDIANNLSIVILDLRPSDEGTYECVVLKYEKDAFEREHLAEVT

SEQ ID NO: 2835 - protein, 101 aa, Artificial Sequence
  CD80 v279 IgV
VIHVTKEVKEVATLSCGHNVSVEELAQTRIYWQKDKKMVLTMMSGEVNIWPEYKNRTIFDITNNLSIMILALRPSDEGTYECVVLKYEKGAFEREHLAEVT

SEQ ID NO: 2836 - protein, 101 aa, Artificial Sequence
  CD80 v280 IgV
VIHVTKEVKEVATLSCGHNVSVEELAQTRIYWQKDKKMVLTMISGDVNIWPEYKNRTIFDITNNLSIVILALRPSDEGTYECVVLKYENDAFKREHLAEVT

SEQ ID NO: 2837 - protein, 101 aa, Artificial Sequence
  CD80 v281 IgV
VIHVTKEVKEVATLSCGHNVSVEELAQTRIYWQKDKKMVLTMMSGDLNIWPEYKNRTIFDITNNLSIVILGLRPSDEGTYECVVMKYEKDAYKREHLAEVT

SEQ ID NO: 2838 - protein, 101 aa, Artificial Sequence
  CD80 v282 IgV
VIHVTKEVKEVATLSCGHNVSVEELAQTRIYWQKDKKMVLTVMSGDVNIWPDYKNRTIFDITNNLSIVILALRPSDEGTYECVVQKYEKDAFKREHLAEVT

SEQ ID NO: 2839 - protein, 101 aa, Artificial Sequence
  CD80 v283 IgV
VIHVTKEVKEVATLSCGHNVSDEELAQTRIYWQKDKKMVLTMMSGDLNIWPEYKNRTIFDITNNLSIVIMALRPSDEGTYECVVLKYEKDAFKREHQAEVT

SEQ ID NO: 2840 - protein, 101 aa, Artificial Sequence
  CD80 v284 IgV
VIHVTKEVKEVATLSCGHNVSVEELAQTRIYWQKDKKMVLSMMSGDVNIWPEYKNRTIFDITNNLSIVILALRPSDEGTYECVVLKYEKDAFKREHQAEVT

SEQ ID NO: 2841 - protein, 101 aa, Artificial Sequence
  CD80 v285 IgV
VIHVTKEVKEVATLSCGHNVSVEELAQTRIYWQKDKKMVLTMMSGDMNIWPEHKNRTIFDITNNLSIVILGLRPSDEGTYECVVLKYEKGAFKREHRAEVT

SEQ ID NO: 2842 - protein, 101 aa, Artificial Sequence
  CD80 v286 IgV
VIHVTKEVKEVATLSCGHNVSVEELAQTRIYWQKDKKMVLTMMSGDMNIWPEYKNRTIFDITNNLSIVILDVHPSDEGTYKCVVLKYEKDAFKREHLAEVT

SEQ ID NO: 2843 - protein, 101 aa, Artificial Sequence
  CD80 v287 IgV
VIHVTKEVKEVATLSCGHNVSVEELAQTRIYWLKDKKMVLTMISGDMNIWPEFKNRTIFDISNNLSIVILALRPSDEGTYECVVQKYEKDAFKREHLAEVT

SEQ ID NO: 2844 - protein, 101 aa, Artificial Sequence
  CD80 v288 IgV
VIHVTKEVKEVATLSCGHNVSVEELAQTRIYWQKDKKTVLTMMSGEVSIWPEYKNRTIFDITNNLSIVILALRPSDEGTYECVVLKYEKDAFKREHLAEVT

SEQ ID NO: 2845 - protein, 101 aa, Artificial Sequence
  CD80 v289 IgV
VIHVTKEVKEVATLSCGHNVSVEELAQTRIYWRKDKKMVLTMMSGDVKIWPEYKNRTIFDITNNLSIVILALRPSDEGTYECVVMKYEKDALKREHLAEVT

SEQ ID NO: 2846 - protein, 101 aa, Artificial Sequence
  CD80 v290 IgV
VIHVTKEVKEVATLSCGHNVSVEELAQTRIYWQKDKKTVLTMVSGDVRIWPEYKNRTIFDITNNLSIVILALRPSDEGTYECVVQKYEKDAFKREHLAEVT

SEQ ID NO: 2847 - protein, 101 aa, Artificial Sequence
  CD80 v291 IgV
VIHVTKEVKEVATLSCGHNVSVEELAQYRIYWHKDKKMVLTMMSGVINIWPEYKNRTIFDITNNLSIVILGLRPSDEGTYECVVLKYEKDAFKREHLAEVT

SEQ ID NO: 2848 - protein, 107 aa, Artificial Sequence
  CD80 v196 IgV
VIHVTKEVKEVATLSCGHNVSVEELEQTRIYWRKDKKMVLTMMSGDLNIWPEYKNRTIFDITNNLSIVILALRPSDEGTYECVVQEYEKDAFKREHLAEVTLSVKAD

SEQ ID NO: 2849 - protein, 107 aa, Artificial Sequence
  CD80 v197 IgV
VIHVTKEVKEVATLSCGHNVSVEELEQTRIYWRKDKKMVLTMMSGDLNIWPEYKNRTIFDITNNLSIVILALRPSDEGTYECVVQKYEKDAFKREHLAEVTLSVKAD

SEQ ID NO: 2850 - protein, 107 aa, Artificial Sequence
  CD80 v198 IgV
VIHVTKEVKEVATLSCGHNVSVEELAQTRIYWQKDKKMVLTMMSGDLNIWPEYKNRTIFDITNNLSIVILALRPSDEGTYECVVQKYEKDAFKREHLAEVTLSVKAD

SEQ ID NO: 2851 - protein, 107 aa, Artificial Sequence
  CD80 v199 IgV
VIHVTKEVKEVATLSCGHNVSVEELEQTRIYWLKDKKMVLTMMSGDLNIWPEYKNRTIFDITNNLSIVILALRPSDEGTYECVVQKYEKDAFKREHLAEVTLSVKAD

SEQ ID NO: 2852 - protein, 107 aa, Artificial Sequence
  CD80 v200 IgV
VIHVTKEVKEVATLSCGHNVSVEELEQTRIYWLKDKKMVLTMMSGDLNIWPEYKNRTIFDITNNLSIVILALRPSDEGTYECVVLKYEKDAFKREHLAEVTLSVKAD

SEQ ID NO: 2853 - protein, 107 aa, Artificial Sequence
  CD80 v201 IgV
VIHVTKEVKEVATLSCGYNVSVEELEQTRIYWLKDKKMVLTMMSGDLNIWPEYKNRTIFDITNNLSIVILALRPSDEGTYECVVQKYEKDAFKREHLAEVTLSVKAD

SEQ ID NO: 2854 - protein, 107 aa, Artificial Sequence
  CD80 v202 IgV
VIHVTKEVKEVATLSCGHNVSVEELAQTRIYWLKDKKMVLTMMSGDINIWPEYKNRTIFDITNNLSIVILALRPSDEGTYECVVLKYEKDAFKREHLAEVTLSVKAD

SEQ ID NO: 2855 - protein, 107 aa, Artificial Sequence
  CD80 v203 IgV
VIHVTKEVKEVATLSCGYNVSVEELAQTRIYWLKDKKMVLTMMSGDINIWPEYKNRTIFDITNNLSIVILALRPSDEGTYECVVLKYEKDAFKREHLAEVTLSVKAD

SEQ ID NO: 2856 - protein, 107 aa, Artificial Sequence
  CD80 v204 IgV
VIHVTKEVKEVATLSCGHNVSVEELAQTRIYWLKDKKMVLTMMSGEINIWPEYKNRTIFDITNNLSIVILALRPSDEGTYECVVLKYEKDAFKREHLAEVTLSVKAD

SEQ ID NO: 2857 - protein, 107 aa, Artificial Sequence
  CD80 v205 IgV
VIHVTKEVKEVATLSCGHNVSVEELAQTRIYWRKDKKMVLTMMSGEINIWPEYKNRTIFDITNNLSIVILALRPSDEGTYECVVLKYEKDAFKREHLAEVTLSVKAD

SEQ ID NO: 2858 - protein, 107 aa, Artificial Sequence
  CD80 v206 IgV
VIHVTKEVKEVATLSCGYNVSVEELAQTRIYWQKDKKMVLTMMSGDLNIWPEYKNRTIFDITNNLSIVILALRPSDEGTYECVVLKYEKDAFKREHLAEVTLSVKAD

SEQ ID NO: 2859 - protein, 107 aa, Artificial Sequence
  CD80 v207 IgV
VIHVTKEVKEVATLSCGHNVSVEELAQTRIYWLKDKKMVLTMMSGDVNIWPEYKNRTIFDITNNLSIVILALRPSDEGTYECVVLKYEKDAFKREHLAEVTLSVKAD

SEQ ID NO: 2860 - protein, 107 aa, Artificial Sequence
  CD80 v208 IgV
VIHVTKEVKEVATLSCGHNVSVEELAQTRIYWLKDKKMVLTMMSGDVNIWPEYKNRTIFDITNNLSIVILALRPSDEGAYECVVLKYEKDAFKREHLAEVTLSVKAD

SEQ ID NO: 2861 - protein, 107 aa, Artificial Sequence
  CD80 v209 IgV
VIHVTKEVKEVATLSCGHNVSVEELAQTRIYWLKDKKMVLSMMSGDVNIWPEYKNRTIFDITNNLSIVILALRPSDEGTYECVVLKYEKDAFKREHLAEVTLSVKAD

SEQ ID NO: 2862 - protein, 107 aa, Artificial Sequence
  CD80 v210 IgV
VIHVTKEVKEVATLSCGHNVSVEELAQTRIYWLKDKKMVLTMMSGDINIWPEYKNRTIFDITNNLSIVILALRPSDEGTYECVVQKYEKDAFKREHLAEVTLSVKAD

SEQ ID NO: 2863 - protein, 107 aa, Artificial Sequence
  CD80 v211 IgV
VIHVTKEVKEVATLSCGHNVSVEELAQTRIYWLKDKKMVLTMMSGDINIWPEYKNRTIFDINNNLSIVILALRPSDEGTYECVVQKYEKDAFKREHLAEVTLSVKAD

SEQ ID NO: 2864 - protein, 107 aa, Artificial Sequence
  CD80 v212 IgV
VIHVTKEVKEVATLSCGHNVSVEELAQTRIYWLKDKKMVLTMMSGDVNIWPEYKNRTIFDITNNLSIVILALRPSDEGTYECVVQKYEKDAFKREHLAEVTLSVKAD

SEQ ID NO: 2865 - protein, 107 aa, Artificial Sequence
  CD80 v213 IgV
VIHVTKEVKEVATLSCGHNVSVEELEQTRIYWQKDKKMVLTMTSGDLNIWPEYKNRTIFDITNNLSIVILALRPSDEGTYECVVQKYEKDAFKQEHLAEVTLSVKAD

SEQ ID NO: 2866 - protein, 107 aa, Artificial Sequence
  CD80 v214 IgV
VIHVTKEVKEVATLSCGHNVSVEELAQTRIYWRKDKEMVLTMMSGDVNIWPEYKNRTIFDITNNLSIVILALRPSDEGTYECVVQKYEKDAFKREHLAEVTLSVKAD

SEQ ID NO: 2867 - protein, 107 aa, Artificial Sequence
  CD80 v215 IgV
VIHVTKEVKEVATLSCGHNVSADELAQTRIYWLKDKKMVLTMMSGDVNIWPEYKNRTIFDITNNLSIVILALRPSDEGTYECVVLKYEKDAFKREHLAEVTLSVKAD

SEQ ID NO: 2868 - protein, 107 aa, Artificial Sequence
  CD80 v216 IgV
VIHVTKEVKEVATLSCGHNVSVEDLAQTRIYWLKDKKMVLTMMSGDVNIWPEYRNRTIFDITNNLSIVILALRPSDEGTYECVVQKYEKDAFKREHLAEVTLSVKAD

SEQ ID NO: 2869 - protein, 107 aa, Artificial Sequence
  CD80 v217 IgV
VIHVTKEVKEVATLPCGHNVSVEELAQTRIYWLKDKKMVLTMMSGDLNIWPEYKNRTIFDITNNLSIVILALRPSDEGTYECVVQKYEKDAFKREHLAEVTLSVKAD

SEQ ID NO: 2870 - protein, 107 aa, Artificial Sequence
  CD80 v218 IgV
VIHVTKDVKEVATLSCGHNVSVEELAQTRIYWQKDKKMVLTMMSGDINIWPEYKNRTIFDITNNLSIVILALRPSDEGTYECVVLKYEKDAFKREHQAEVTLSVKAD

SEQ ID NO: 2871 - protein, 107 aa, Artificial Sequence
  CD80 v219 IgV
VIHVTKEVKEVATLSCGHNVSVEELAQTRIYWLKDKKMVLSMISGDMNIWPEYKNRTIFDITNNLSIVILALRPSDEGTYECVVLKYEKDAFKREHLAEVTLSVKAD

SEQ ID NO: 2872 - protein, 107 aa, Artificial Sequence
  CD80 v220 IgV
VIHVTKEVKEVATLSCGHNVSVEELAQTRIYWQKDKKMVLTMMSGDINIWPEYRNRTIFDITNNLSIVILALRPSDEGTYECVVEKYEKDAFKREHLAEVTLSVKAD

SEQ ID NO: 2873 - protein, 107 aa, Artificial Sequence
  CD80 v221 IgV
VIHVTKEVKEVATLSCGHNVSVEELAQTRIYWKKDKKMVLTMMSGVMNIWPEYKNRTIFDITNNLSIVILALRPSDEGTYECVVQKYEKDAFKREHLAEVTLSVKAD

SEQ ID NO: 2874 - protein, 107 aa, Artificial Sequence
  CD80 v222 IgV
VIHVTKEVKEVATLSCGHNVSVEELAQTRISWQKDKKMVLTMMSGDLNIWPEYKNRTIFDITNNLSIVILALRPSDEGLYECVVLKYGKDAFKREHLAEVTLSVKAD

SEQ ID NO: 2875 - protein, 107 aa, Artificial Sequence
  CD80 v223 IgV
VIHVTKEVKEVATLSCGLNVSAEELAQTRIYWQKDKKMVLTMMSGDLTIWPEYKNRTIFDITNNLSIVILALRPSDEGTYECVVQKYEKDAFKREHLAEVTLSVKAD

SEQ ID NO: 2876 - protein, 107 aa, Artificial Sequence
  CD80 v224 IgV
VIHVTKEVKEVATLSCGHNVSVEELAHTRIYWQKDKKMVLTMMSGDLNIWPEYKNRTIFDITNNLSIVILALRPSDEGTYECVVQKYEKDAFKQKHLAEVTLSVKAD

SEQ ID NO: 2877 - protein, 107 aa, Artificial Sequence
  CD80 v225 IgV
VIHVTKEVKEVATLSCGHNVSVEELAQTRIYWKKDKKMVLTMMSGDVNIWPEYKNRTIFDITNNLSIVILALRPSDEGTYECVVLKYEEDAFRREHLAEVTLSVKAD

SEQ ID NO: 2878 - protein, 107 aa, Artificial Sequence
  CD80 v226 IgV
VIHVTKEVKEVATLSCGHNVSVEELAQTRIYWQKDKKMVLTMMSGDINIWPEYKNRTIFDITNNLSIVILALRPSDAGTYECVVQKYEKDAFKWEHLAEVTLSVKAD

SEQ ID NO: 2879 - protein, 107 aa, Artificial Sequence
  CD80 v227 IgV
VIHVTKEVKEVATLSCGHNVSVEELEQTRIYWQKDKKMVLTMISGDLNIWPEYKNRTIFDITNNLSIVILALRPSDEGTYECVVQEYEKDAFKWEHLAEVTLSVKAD

SEQ ID NO: 2880 - protein, 107 aa, Artificial Sequence
  CD80 v228 IgV
VIHVTKEVKEVATLSCGHNVSVEELAHTRIYWLKDKKMVLTMMSGDVNIWPEYKDRTIFDITNNLSIVILALRPSDEGTYECVVQKYENDAFKREHLAEVTLSVKAD

SEQ ID NO: 2881 - protein, 107 aa, Artificial Sequence
  CD80 v229 IgV
VIHVTKEVKEVATLSCGYNASVEELAQTRIYWLKDKKMVLTMMSGDVNIWPEFKNRTIFDITNNLSIVILALRPSDEGTYECVVLKYEKDAFKREHLAEVTLSVKAD

SEQ ID NO: 2882 - protein, 107 aa, Artificial Sequence
  CD80 v230 IgV
VIHVTKEVKEVATLSCGHNVSAEELAQTRIYWQKDKKMVLTMMSGDMNIWPEYKNRTIFDITNNLSIEILDLRPSDEGTYECVVLKYEKDAFKREHLAEVTLSVKAD

SEQ ID NO: 2883 - protein, 107 aa, Artificial Sequence
  CD80 v231 IgV
VIHVTKEVKEVATLSCGHNVSVEELAQTRIYWLKDKKMVLTMMSGDLNIWPEYKNRTIFDITNNLSIVILGLRPSDEGTYECVVLKYEKDASKREHLAEVTLSVKAD

SEQ ID NO: 2884 - protein, 107 aa, Artificial Sequence
  CD80 v232 IgV
VIHVTKEVKEVATLSCGHNVSAEELAQTHIYWQKDKKMVLTMMSGEINIWPEYKNRTIFDITNNLSIVILALRPSDEGTYECVVLKYEKDAFKREHLAEVTLSVKAD

SEQ ID NO: 2885 - protein, 107 aa, Artificial Sequence
  CD80 v233 IgV
VIHVTKEVKEVATLSCGHNVSVEELAQTRIYWLKDKKMVLTMISGDMNIWPEYKNRTIFDITNNLSIVILALRPSDEGTYECVVQKYEKDAFKWEHLAEVTLSVKAD

SEQ ID NO: 2886 - protein, 107 aa, Artificial Sequence
  CD80 v234 IgV
VIHVTKEVKEVATLSCGYNVSVEELAQTRIYWQKDKKMVLTMMSGDMNIWPEYKNRTIFDITNNLSIMILALRPSDEGTYECVVLKYEKDAFKREHQAEVTLSVKAD

SEQ ID NO: 2887 - protein, 107 aa, Artificial Sequence
  CD80 v235 IgV
VIHVTKEVKEVATLSCGHNVSVEELAQTRIYWLKDKKMVLTMMSGDLNIWPEYKNRTIFDITNNLSIMILALRPSDEGTYECVVQKYDKDAFKREHLAEVTLSVKAD

SEQ ID NO: 2888 - protein, 107 aa, Artificial Sequence
  CD80 v236 IgV
VIHVTKEVKEVATLSCGHNVSVEELAQTRIYWLKDKKMVLTMVSGDINIWPEYKNRTIFDITNNLSIVILGLRPSDEGTYECVVLKYEKDAFKREHLAEVTLSVKAD

SEQ ID NO: 2889 - protein, 107 aa, Artificial Sequence
  CD80 v237 IgV
VIHVTKEVKEVATLSCGHNVSVEELAQTRIYWQKDKKMVLTMMSGDLNIWPEYKNRTIFDITNNLSIVILGLRPSDEGTYECVVLKYEKDAFKREHQAEVTLSVKAD

SEQ ID NO: 2890 - protein, 107 aa, Artificial Sequence
  CD80 v238 IgV
VIHVTKEVKEVATLSCGHNVSVEELAQTRIYWQKDKKMVLTMMSGDVNIWPEYKNRTIFDITNNLSIVILGLRPSDEGTYECVVMKYEKDAFKREHQAEVTLSVKAD

SEQ ID NO: 2891 - protein, 107 aa, Artificial Sequence
  CD80 v239 IgV
VIHVTKEVKEVATLSCGYNVSVEELAQTRIHWQKDKKMVLTMMSGDVNIWPEYKNRTIFDITNNLSIVILGLRPSDEGTYECVVQKYEKDAFKREHLAEVTLSVKAD

SEQ ID NO: 2892 - protein, 107 aa, Artificial Sequence
  CD80 v240 IgV
VIHVTKEVKEVATLSCGHNVSVEELAQTRIYWQKDKKMVLTMMSGEVNIWPEYKNRTIFDITNNLSIVILALRPSDEGTYECVVLKYEKDAFKREHQAEVTLSVKAD

SEQ ID NO: 2893 - protein, 107 aa, Artificial Sequence
  CD80 v241 IgV
VIHVTKEVKEVATLSCGHNVSVEELAQTRIYWQKDKKMVLTMMSGVINIWPEYKNRTIFDITNNLSIVILGLRPSDEGTYECVVLKYEKDAVKREHLAEVTLSVKAD

SEQ ID NO: 2894 - protein, 107 aa, Artificial Sequence
  CD80 v242 IgV
VIHVTKEVKEVATLSCGHNVSVEELAQTRIYWQKDKKMVLTMMSGDVNIWPEYKNRTIFDIANNLSIVILGLRPSDEGTYECAVLKHEKDAFKREHMAEVTLSVKAD

SEQ ID NO: 2895 - protein, 107 aa, Artificial Sequence
  CD80 v243 IgV
VIHVTKEVKEVATLSCGHNVSVEELAQTRIYWLKDKKMVLTMMSGDMKIWPEYKNRTIFDITNNLSIVILALRPSDEGTYECVVQKYEKDAFKREHQAEVTLSVKAD

SEQ ID NO: 2896 - protein, 107 aa, Artificial Sequence
  CD80 v244 IgV
VIHVTKEVKEVATLSCGHNVSVEELAQTRIYWQKDKKMVLTMMSGDMNIWPEYKNRTIFDITNNLSIVILALRPSDEGTYECVVQKYEKDAFTRVHQAEVTLSVKAD

SEQ ID NO: 2897 - protein, 107 aa, Artificial Sequence
  CD80 v245 IgV
VIHVTKEVKEVATLSCGHNVSVEELAQTRIYWQKDKKMVLTMMSGDVKIWPEYKNRTIFDITNNLSIMILALRPSDEGTYECVVLKYENDAFKREHLAEVTLSVKAD

SEQ ID NO: 2898 - protein, 107 aa, Artificial Sequence
  CD80 v246 IgV
VIHVTKEVKEVATLSCGHNVSVEELAQTRIYWLKDKKMVLTMMSGDIDIWPEYKNRTIFDITNNLSIVILGLRPSDEGTYECVVLKYEKDAFKREHLAEVTLSVKAD

SEQ ID NO: 2899 - protein, 107 aa, Artificial Sequence
  CD80 v247 IgV
VIHVTKEVKEVATLSCGHNVSVEELAQTHIYWQKDKKMVLTMVSGDINVWPEYKNRTIFDITNNLSIVILALRPSDEGTYECVVLKYEKDAFKREHLAEVTLSVKAD

SEQ ID NO: 2900 - protein, 107 aa, Artificial Sequence
  CD80 v248 IgV
VIHVTKEVKEVATLSCGHNVSVEELAHTRIYWQKDKKMVLTMMSGDINIWPEYKNRTIFDITNNLSIVILALRPSDEGTYECVVQKYEKGAFKREHLAEVTLSVKAD

SEQ ID NO: 2901 - protein, 107 aa, Artificial Sequence
  CD80 v249 IgV
VIHVTKEVKEVATLSCGHNVSVEELAQTRIYWQKDKKMVLTMMSGDINIWPEYKNRTIFDITNNLSIVILALRPSDEGTYECVVQKYEKGAFKREHLAEVTLSVKAD

SEQ ID NO: 2902 - protein, 107 aa, Artificial Sequence
  CD80 v250 IgV
VIHVTKEVKEVATLSCGHNVSVEELAQTRIYWQKDKKMVLTMMSGDINIWPEYKNRTIFDISNNLSIVILALRPSDEGTYECVVQKYEKDAFKREHLAEVTLSVKAD

SEQ ID NO: 2903 - protein, 107 aa, Artificial Sequence
  CD80 v251 IgV
VIHVTKEVKEVATLSCGHNVSVEELEQTRIYWQKDKKMVLTMMSGDLNIWPEYKNRTIFDITNNLSIVILGLRPSDEGTYECVVLKYEKDAFKREHLAEVTLSVKAD

SEQ ID NO: 2904 - protein, 107 aa, Artificial Sequence
  CD80 v252 IgV
VIHVTKEVKEVATLSCGHNVSVEELAQTRIYWQKDKKMVLTMMSGDINIWPEYKNRTIFDITNNLSIVILALRPSDEGTYECVVLKQEEDAFKREHLAEVTLSVKAD

SEQ ID NO: 2905 - protein, 107 aa, Artificial Sequence
  CD80 v253 IgV
VIHVTKEVKEVATLSCGHNVSAEELAQTRIYWQKDKKMVLTMMSGDINIWPEYKNRTIFDITNNLSIVILALRPSDEGTYECVVLKNEKDAFKREHLAEVTLSVKAD

SEQ ID NO: 2906 - protein, 107 aa, Artificial Sequence
  CD80 v254 IgV
VIHVTKEVKEVATLSCGYNVSVEELEQTRIYWQKDKKMVLTMMSGDLNIWPEYKNRTIFDITNNLSIVILALRPSDEGTYECVVQKYEKGAFKREHLAEVTLSVKAD

SEQ ID NO: 2907 - protein, 107 aa, Artificial Sequence
  CD80 v255 IgV
VIHVTKEVKEVATLSCGHNVSVEELAQTRIYWQKDKKMVLTMMSGDLNIWPEYKNRTIFDITNNLSIVILGLRPSDEGTYECVVQKYEKDAFKREHLAEVTLSVKAD

SEQ ID NO: 2908 - protein, 107 aa, Artificial Sequence
  CD80 v256 IgV
VIHVTKEVKEVATLSCGHNVSVEELAQTRIYWQKDKKMVLTMMSGDVNIWPEYKNRTIFDITNNLSIVILGLRPSDEGTYECVVLKYDKDAFKREHLAEVTLSVKAD

SEQ ID NO: 2909 - protein, 107 aa, Artificial Sequence
  CD80 v257 IgV
VIHVTKEVKEVATLSCGHNVSVEELAQTRIYWQKDKKMVLTMMSGDMNIWPEYKNRTIFDITNNLSIVILGLRPSDEGTYECVVLKYEKDAFKREHLAEVTLSVKAD

SEQ ID NO: 2910 - protein, 107 aa, Artificial Sequence
  CD80 v258 IgV
VIHVTKEVKEVATLSCGHNVSVEELAQTRIYWQKDKKMVLTMMSGDVNIWPEYKNRTIFDITNNLSIVILGLRPSDEGTYECVVLKYEKDAFKREHLAEVTLSVKAD

SEQ ID NO: 2911 - protein, 107 aa, Artificial Sequence
  CD80 v259 IgV
VIHVTKEVKEVATLSCGHNVSVEELAQTRVYWQKDKKMVLTMMSGDVNIWPEYKNRTIFDITNNLSIVILGLRPSDEGTYECVVLKYEKDVFKREHLAEVTLSVKAD

SEQ ID NO: 2912 - protein, 107 aa, Artificial Sequence
  CD80 v260 IgV
VIHVTKEVKEVATLSCGHNVSVEELAQTRVCWQKDKKMVLTMMSGDVNIWPEYKNRTIFDITNNLSIVILGLRPSDEGTYECVVMKYEKDAFKREHLAEVTLSVKAD

SEQ ID NO: 2913 - protein, 107 aa, Artificial Sequence
  CD80 v261 IgV
VIHVTKEVKEVATLSCGHNVSDEELAQTRIYWQKDKKMVLTMMSGDLNIWPEYKNRTIFDITNNLSIVILALRPSDEGTYECVVQKYEKDAFKREHLAEVTLSVKAD

SEQ ID NO: 2914 - protein, 107 aa, Artificial Sequence
  CD80 v262 IgV
VIHVTKEVKEVATLSCGYNVSVEELAQTRIYWQKDKKMVLTMMSGDMKIWPEYKNRTIFDITNNLSIVILALRPSDEGTYECVVLKYEKDAFKREHLAEVTLSVKAD

SEQ ID NO: 2915 - protein, 107 aa, Artificial Sequence
  CD80 v263 IgV
VIHVTKEVKEVATLSCGHNVSVEELAQTRIYWQKDKKMVLSMMSGDVNIWPEYKNRTIFDITNNLSIVILGLRPSDEGTYECVVLKYENDAFKREHLAEVTLSVKAD

SEQ ID NO: 2916 - protein, 107 aa, Artificial Sequence
  CD80 v264 IgV
VIHVTKEVKEVATLSCGHNVSVEELAQTRIYWQKDKKMVLTMMSGDVTIWPEYKNRTIFDITNNLSIVILALRPSDEGTYECVVQKYEKDAFKREHLAEVTLSVKAD

SEQ ID NO: 2917 - protein, 107 aa, Artificial Sequence
  CD80 v265 IgV
VIHVTKEVKEVATLSCGHNVSVEELAQTRIYWQKDKKMVLTMMSGEVNIWPEYKNRTIFDITNNLSIVILDLRPSDEGTYECVVLKYEKGAFKREHLAEVTLSVKAD

SEQ ID NO: 2918 - protein, 107 aa, Artificial Sequence
  CD80 v266 IgV
VIHVTKEVKEVATLSCGHNVSVEELAQTRIYWQKDKKMVLTMMSGEVNIWPEYKNRTIFDITNNLSIVILDLRPSDEGTYECVVLKYEKDAFKREHLAEVTLSVKAD

SEQ ID NO: 2919 - protein, 107 aa, Artificial Sequence
  CD80 v267 IgV
VIHVTKEVKEVATLSCGHNVSVEELAQTRIYWQKDKKMVLSMISGDMNIWPEYKNRTIFDITNNLSIVILGLRPSDEGTYECVVLKYEKGAFKREHLAEVTLSVKAD

SEQ ID NO: 2920 - protein, 107 aa, Artificial Sequence
  CD80 v268 IgV
VIHVTKEVKEVATLSCGHNVSVEELAQTRIYWQKDKKMVLSMISGDVNIWPEYKNRTIFDITNNLSIVILGLRPSDEGTYECVVLKYEKDAFKREHLAEVTLSVKAD

SEQ ID NO: 2921 - protein, 107 aa, Artificial Sequence
  CD80 v269 IgV
VIHVTKEVKEVATLSCGHNVSVEELAQTRIYWQKDKKMVLSMISGDLNIWPEYKNRTIFDITNNLSIVILGLRPSDEGTYECVVLKYEKDAFKREHLAEVTLSVKAD

SEQ ID NO: 2922 - protein, 107 aa, Artificial Sequence
  CD80 v270 IgV
VIHVTKEVKEVATLSCGYNVSAEELAQTRIYWQKDKKMVLTMMSGDVNIWPEYKNRTIFDISNNLSIVILGLRPSDEGTYECVVLKYEKDAFKREHLAEVTLSVKAD

SEQ ID NO: 2923 - protein, 107 aa, Artificial Sequence
  CD80 v271 IgV
VIHVTKEVKEVATLSCGYNVSVEELEQTRIYWQKDKKMVLTMMSGDLNIWPEYKNRTIFDITNNLSIMILGLRPSDEGTYECVVLKYEKGAFKREHLAEVTLSVKAD

SEQ ID NO: 2924 - protein, 107 aa, Artificial Sequence
  CD80 v272 IgV
VIHVTKEVKEVATLSCGHNVSVEELAQTRIYWQKDKEMVLTMMSGDVDIWPEYKNRTIFDITNNLSIVILALRPSDEGTYECVVQKYEKNAFKREHLAEVTLSVKAD

SEQ ID NO: 2925 - protein, 107 aa, Artificial Sequence
  CD80 v273 IgV
VIHVTKEVKEVATLSCGHNVSVEELAHTRIYWQKDKKMVLTMMSGVLNIWPEYKNRTIFDITNNLSIVILGLRPSDEGTYECVVLKYEKDAFKREHLAEVTLSVKAD

SEQ ID NO: 2926 - protein, 107 aa, Artificial Sequence
  CD80 v274 IgV
VIHVTKEVKEVATLSCGHNVSLEELAHTRIYWQKDKKMVLTMMSGDINIWPEYKNRTIFDITNNLSIVILGLRPSDEGTYECVVLKYEKDAFKREHLAEVTLSVKAD

SEQ ID NO: 2927 - protein, 107 aa, Artificial Sequence
  CD80 v275 IgV
VIHVTKEVKEVATLSCGHNVSVEELAQTRIYWQKDKKMVLTMMSGVLNIWPEYKNRTIFDITNNLSIMILALRPSDEGTYECVVQKYDKDAFKREHLAEVTLSVKAD

SEQ ID NO: 2928 - protein, 107 aa, Artificial Sequence
  CD80 v276 IgV
VIHVTKEVKEVATLSCGHNVSVEELAQTRIYWQKDKKMVLSMVSGDINIWPEYKNRTIFDITNNLSIVIMGLRPSDEGTYECVVLKYEKDAFKREHLAEVTLSVKAD

SEQ ID NO: 2929 - protein, 107 aa, Artificial Sequence
  CD80 v277 IgV
VIHVTKEVKEVATLSCGHNVSVEELAQTRIYWQKDKKMVLTMMSGEVNIWPEYKNRTIFDITDNLSIVILALRPSDEGTYECVVQKYEKDAFKREHLAEVTLSVKAD

SEQ ID NO: 2930 - protein, 107 aa, Artificial Sequence
  CD80 v278 IgV
VIHVTKEVKEVATLSCGHNVSVEELAQTRIYWQKDKKMVLTMMSGDVNIWPEYKNRTIFDIANNLSIVILDLRPSDEGTYECVVLKYEKDAFEREHLAEVTLSVKAD

SEQ ID NO: 2931 - protein, 107 aa, Artificial Sequence
  CD80 v279 IgV
VIHVTKEVKEVATLSCGHNVSVEELAQTRIYWQKDKKMVLTMMSGEVNIWPEYKNRTIFDITNNLSIMILALRPSDEGTYECVVLKYEKGAFEREHLAEVTLSVKAD

SEQ ID NO: 2932 - protein, 107 aa, Artificial Sequence
  CD80 v280 IgV
VIHVTKEVKEVATLSCGHNVSVEELAQTRIYWQKDKKMVLTMISGDVNIWPEYKNRTIFDITNNLSIVILALRPSDEGTYECVVLKYENDAFKREHLAEVTLSVKAD

SEQ ID NO: 2933 - protein, 107 aa, Artificial Sequence
  CD80 v281 IgV
VIHVTKEVKEVATLSCGHNVSVEELAQTRIYWQKDKKMVLTMMSGDLNIWPEYKNRTIFDITNNLSIVILGLRPSDEGTYECVVMKYEKDAYKREHLAEVTLSVKAD

SEQ ID NO: 2934 - protein, 107 aa, Artificial Sequence
  CD80 v282 IgV
VIHVTKEVKEVATLSCGHNVSVEELAQTRIYWQKDKKMVLTVMSGDVNIWPDYKNRTIFDITNNLSIVILALRPSDEGTYECVVQKYEKDAFKREHLAEVTLSVKAD

SEQ ID NO: 2935 - protein, 107 aa, Artificial Sequence
  CD80 v283 IgV
VIHVTKEVKEVATLSCGHNVSDEELAQTRIYWQKDKKMVLTMMSGDLNIWPEYKNRTIFDITNNLSIVIMALRPSDEGTYECVVLKYEKDAFKREHQAEVTLSVKAD

SEQ ID NO: 2936 - protein, 107 aa, Artificial Sequence
  CD80 v284 IgV
VIHVTKEVKEVATLSCGHNVSVEELAQTRIYWQKDKKMVLSMMSGDVNIWPEYKNRTIFDITNNLSIVILALRPSDEGTYECVVLKYEKDAFKREHQAEVTLSVKAD

SEQ ID NO: 2937 - protein, 107 aa, Artificial Sequence
  CD80 v285 IgV
VIHVTKEVKEVATLSCGHNVSVEELAQTRIYWQKDKKMVLTMMSGDMNIWPEHKNRTIFDITNNLSIVILGLRPSDEGTYECVVLKYEKGAFKREHRAEVTLSVKAD

SEQ ID NO: 2938 - protein, 107 aa, Artificial Sequence
  CD80 v286 IgV
VIHVTKEVKEVATLSCGHNVSVEELAQTRIYWQKDKKMVLTMMSGDMNIWPEYKNRTIFDITNNLSIVILDVHPSDEGTYKCVVLKYEKDAFKREHLAEVTLSVKAD

SEQ ID NO: 2939 - protein, 107 aa, Artificial Sequence
  CD80 v287 IgV
VIHVTKEVKEVATLSCGHNVSVEELAQTRIYWLKDKKMVLTMISGDMNIWPEFKNRTIFDISNNLSIVILALRPSDEGTYECVVQKYEKDAFKREHLAEVTLSVKAD

SEQ ID NO: 2940 - protein, 107 aa, Artificial Sequence
  CD80 v288 IgV
VIHVTKEVKEVATLSCGHNVSVEELAQTRIYWQKDKKTVLTMMSGEVSIWPEYKNRTIFDITNNLSIVILALRPSDEGTYECVVLKYEKDAFKREHLAEVTLSVKAD

SEQ ID NO: 2941 - protein, 107 aa, Artificial Sequence
  CD80 v289 IgV
VIHVTKEVKEVATLSCGHNVSVEELAQTRIYWRKDKKMVLTMMSGDVKIWPEYKNRTIFDITNNLSIVILALRPSDEGTYECVVMKYEKDALKREHLAEVTLSVKAD

SEQ ID NO: 2942 - protein, 107 aa, Artificial Sequence
  CD80 v290 IgV
VIHVTKEVKEVATLSCGHNVSVEELAQTRIYWQKDKKTVLTMVSGDVRIWPEYKNRTIFDITNNLSIVILALRPSDEGTYECVVQKYEKDAFKREHLAEVTLSVKAD

SEQ ID NO: 2943 - protein, 107 aa, Artificial Sequence
  CD80 v291 IgV
VIHVTKEVKEVATLSCGHNVSVEELAQYRIYWHKDKKMVLTMMSGVINIWPEYKNRTIFDITNNLSIVILGLRPSDEGTYECVVLKYEKDAFKREHLAEVTLSVKAD

SEQ ID NO: 2944 - protein, 188 aa, Artificial Sequence
  tCD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLH

SEQ ID NO: 2945 - protein, 383 aa, Artificial Sequence
  CTLA-4 ECD
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2946 - protein, 92 aa, Homo sapiens
  MISC_FEATURE: LFA-3 IgV
SQQIYGVVYGNVTFHVPSNVPLKEVLWKKQKDKVAELENSEFRAFSSFKNRVYLDTVSGSLTIYNLTSSDEDEYEMESPNITDTMKFFLYVL

SEQ ID NO: 2947 - protein, 102 aa, Artificial Sequence
  unmodified CTLA-4 IgV (39-140 of P16410)
HVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYY

SEQ ID NO: 2948 - protein, 126 aa, Artificial Sequence
  L12P/A26T/L63P/L98Q/Y105L ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 2949 - protein, 126 aa, Artificial Sequence
  L63P/L98R/N110K ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVERMYPPPYYLGIGKGTQIYVIDPEPCPDSD

SEQ ID NO: 2950 - protein, 126 aa, Artificial Sequence
  L12P/A26T ECD
KAMHVAQPAVVPASSRGIASFVCEYTSPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSD

SEQ ID NO: 2951 - protein, 126 aa, Artificial Sequence
  L12P/A26T/L63P ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVELMYPPPYYLGIGNGTQIYVIDPEPCPDSD

SEQ ID NO: 2952 - protein, 126 aa, Artificial Sequence
  L63P/L98Q/Y105L ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 2953 - protein, 126 aa, Artificial Sequence
  L98Q/Y105L ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 2954 - protein, 126 aa, Artificial Sequence
  L63P ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVELMYPPPYYLGIGNGTQIYVIDPEPCPDSD

SEQ ID NO: 2955 - protein, 126 aa, Artificial Sequence
  L98R/N110K ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVERMYPPPYYLGIGKGTQIYVIDPEPCPDSD

SEQ ID NO: 2956 - protein, 126 aa, Artificial Sequence
  L12P/A26T/L63P/L98Q/M99L/Y105L ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 2957 - protein, 126 aa, Artificial Sequence
  E33M/Q82H/L98Q/M99L/Y105L ECD
KAMHVAQPAVVLASSRGIASFVCEYASPGKATMVRVTVLRQADSQVTEVCAATYMMGNELTFLDDSICTGTSSGNQVNLTIHGLRAMDTGLYICKVEQLYPPPYLLGIGNGTQIYVIDPEPCPDSD

SEQ ID NO: 2958 - protein, 126 aa, Artificial Sequence
  L63P/S72G/L98Q/M99L/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 2959 - protein, 126 aa, Artificial Sequence
  S14N/R16C/I18T/M56K/T61A/L63P/A86T/M99L ECD
KAMHVAQPAVVLANSCGTASFVCEYASPGKATEVRVTVLRQADSQVTEVCAATYMKGNELAFPDDSICTGTSSGNQVNLTIQGLRTMDTGLYICKVELLYPPPYYLGIGNGTQIYVIDPEPCPDSD

SEQ ID NO: 2960 - protein, 126 aa, Artificial Sequence
  S27P/M56K/L63P/S72G/S73R/T89A/M99L/Y105L/I117M ECD
KAMHVAQPAVVLASSRGIASFVCEYAPPGKATEVRVTVLRQADSQVTEVCAATYMKGNELTFPDDSICTGTGRGNQVNLTIQGLRAMDAGLYICKVELLYPPPYLLGIGNGTQIYVMDPEPCPDSD

SEQ ID NO: 2961 - protein, 126 aa, Artificial Sequence
  M56K/L63P/N75D/V96I/M99L/Y105L/L106I ECD
KAMHVAQPAVVLASSRGIASFVCEYASPGKATEVRVTVLRQADSQVTEVCAATYMKGNELTFPDDSICTGTSSGDQVNLTIQGLRAMDTGLYICKIELLYPPPYLIGIGNGTQIYVIDPEPCPDSD

SEQ ID NO: 2962 - protein, 126 aa, Artificial Sequence
  L63P/S72G/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVELMYPPPYLLGIGNGTQIYVIDPEPCPDSD

SEQ ID NO: 2963 - protein, 126 aa, Artificial Sequence
  L63P/L98Q/M99L/Y105L/I117M ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVMDPEPCPDSD

SEQ ID NO: 2964 - protein, 126 aa, Artificial Sequence
  L63P/S72G/L98Q/M99L/Y105L/L106I/I117L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYLIGIGNGTQIYVLDPEPCPDSD

SEQ ID NO: 2965 - protein, 126 aa, Artificial Sequence
  A26T/L63P/S72G/L98Q/Y105L/L106I/I117L ECD
KAMHVAQPAVVLASSRGIASFVCEYTSPGKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSD

SEQ ID NO: 2966 - protein, 126 aa, Artificial Sequence
  L63P/L98Q/V116A ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYYLGIGNGTQIYAIDPEPCPDSD

SEQ ID NO: 2967 - protein, 126 aa, Artificial Sequence
  G29W/L98Q/M99L/Y105L ECD
KAMHVAQPAVVLASSRGIASFVCEYASPWKATEVRVTVLRQADSQVTEVCAATYMMGNELTFLDDSICTGTSSGNQVNLTIQGLRAMDTGLYICKVEQLYPPPYLLGIGNGTQIYVIDPEPCPDSD

SEQ ID NO: 2968 - protein, 126 aa, Artificial Sequence
  T37S/M56V/L98Q/Y105L ECD
KAMHVAQPAVVLASSRGIASFVCEYASPGKATEVRVSVLRQADSQVTEVCAATYMVGNELTFLDDSICTGTSSGNQVNLTIQGLRAMDTGLYICKVEQMYPPPYLLGIGNGTQIYVIDPEPCPDSD

SEQ ID NO: 2969 - protein, 126 aa, Artificial Sequence
  A26T/Y54F/M56K/M99L/Y105L ECD
KAMHVAQPAVVLASSRGIASFVCEYTSPGKATEVRVTVLRQADSQVTEVCAATFMKGNELTFLDDSICTGTSSGNQVNLTIQGLRAMDTGLYICKVELLYPPPYLLGIGNGTQIYVIDPEPCPDSD

SEQ ID NO: 2970 - protein, 126 aa, Artificial Sequence
  L12P/I18T/A26T/M55T/T69S/S72G/M99L/Y105L ECD
KAMHVAQPAVVPASSRGTASFVCEYTSPGKATEVRVTVLRQADSQVTEVCAATYTMGNELTFLDDSICSGTGSGNQVNLTIQGLRAMDTGLYICKVELLYPPPYLLGIGNGTQIYVIDPEPCPDSD

SEQ ID NO: 2971 - protein, 126 aa, Artificial Sequence
  V22I/L63P/L98Q/Y105L/I117M ECD
KAMHVAQPAVVLASSRGIASFICEYASPGKATEVRVTVLRQADSQVTEVCAATYMMGNELTFPDDSICTGTSSGNQVNLTIQGLRAMDTGLYICKVEQMYPPPYLLGIGNGTQIYVMDPEPCPDSD

SEQ ID NO: 2972 - protein, 126 aa, Artificial Sequence
  A26T/L63P/S72G/L98Q/M99L/Y105L ECD
KAMHVAQPAVVLASSRGIASFVCEYTSPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 2973 - protein, 126 aa, Artificial Sequence
  E33M/A42T/L98Q/Y105L ECD
KAMHVAQPAVVLASSRGIASFVCEYASPGKATMVRVTVLRQTDSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 2974 - protein, 126 aa, Artificial Sequence
  M55T/E97Q/M99L/Y105F ECD
KAMHVAQPAVVLASSRGIASFVCEYASPGKATEVRVTVLRQADSQVTEVCAATYTMGNELTFLDDSICTGTSSGNQVNLTIQGLRAMDTGLYICKVQLLYPPPYFLGIGNGTQIYVIDPEPCPDSD

SEQ ID NO: 2975 - protein, 126 aa, Artificial Sequence
  M55T/S72G/L98Q/M99L/Y105L ECD
KAMHVAQPAVVLASSRGIASFVCEYASPGKATEVRVTVLRQADSQVTEVCAATYTMGNELTFLDDSICTGTGSGNQVNLTIQGLRAMDTGLYICKVEQLYPPPYLLGIGNGTQIYVIDPEPCPDSD

SEQ ID NO: 2976 - protein, 126 aa, Artificial Sequence
  R16C/G29W/E33V/M55T/L63P/L98Q/Y105L ECD
KAMHVAQPAVVLASSCGIASFVCEYASPWKATVVRVTVLRQADSQVTEVCAATYTMGNELTFPDDSICTGTSSGNQVNLTIQGLRAMDTGLYICKVEQMYPPPYLLGIGNGTQIYVIDPEPCPDSD

SEQ ID NO: 2977 - protein, 126 aa, Artificial Sequence
  L12P/A26T/L63P/L98Q/Y105L/L106I ECD
KAMHVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYLIGIGNGTQIYVIDPEPCPDSD

SEQ ID NO: 2978 - protein, 126 aa, Artificial Sequence
  M56L/L63P/L98Q/Y105L/L106I/I117L ECD
KAMHVAQPAVVLASSRGIASFVCEYASPGKATEVRVTVLRQADSQVTEVCAATYMLGNELTFPDDSICTGTSSGNQVNLTIQGLRAMDTGLYICKVEQMYPPPYLIGIGNGTQIYVLDPEPCPDSD

SEQ ID NO: 2979 - protein, 126 aa, Artificial Sequence
  S15P/I18V/M56T/L98Q/M99L/Y105L ECD
KAMHVAQPAVVLASPRGVASFVCEYASPGKATEVRVTVLRQADSQVTEVCAATYMTGNELTFLDDSICTGTSSGNQVNLTIQGLRAMDTGLYICKVEQLYPPPYLLGIGNGTQIYVIDPEPCPDSD

SEQ ID NO: 2980 - protein, 126 aa, Artificial Sequence
  I18T/G29W/L63P/L98Q/Y105L ECD
KAMHVAQPAVVLASSRGTASFVCEYASPWKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 2981 - protein, 126 aa, Artificial Sequence
  L63P/Q82H/L98Q/M99L/Y105L ECD
KAMHVAQPAVVLASSRGIASFVCEYASPGKATEVRVTVLRQADSQVTEVCAATYMMGNELTFPDDSICTGTSSGNQVNLTIHGLRAMDTGLYICKVEQLYPPPYLLGIGNGTQIYVIDPEPCPDSD

SEQ ID NO: 2982 - protein, 126 aa, Artificial Sequence
  L98Q/M99L/Y105L/L106I/I117T ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLIGIGNGTQIYVTDPEPCPDSD

SEQ ID NO: 2983 - protein, 126 aa, Artificial Sequence
  L98Q/M99L/Y105L/L106I/Y115N ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLIGIGNGTQINVIDPEPCPDSD

SEQ ID NO: 2984 - protein, 126 aa, Artificial Sequence
  M55T/L63P/T71I/M99L/Y105L ECD
KAMHVAQPAVVLASSRGIASFVCEYASPGKATEVRVTVLRQADSQVTEVCAATYTMGNELTFPDDSICTGISSGNQVNLTIQGLRAMDTGLYICKVELLYPPPYLLGIGNGTQIYVIDPEPCPDSD

SEQ ID NO: 2985 - protein, 126 aa, Artificial Sequence
  A26T/T53S/M56K/L63P/L98Q/Y105L ECD
KAMHVAQPAVVLASSRGIASFVCEYTSPGKATEVRVTVLRQADSQVTEVCAASYMKGNELTFPDDSICTGTSSGNQVNLTIQGLRAMDTGLYICKVEQMYPPPYLLGIGNGTQIYVIDPEPCPDSD

SEQ ID NO: 2986 - protein, 126 aa, Artificial Sequence
  I18T/A26T/L63P/Q82R/L98Q/Y105L ECD
KAMHVAQPAVVLASSRGTASFVCEYTSPGKATEVRVTVLRQADSQVTEVCAATYMMGNELTFPDDSICTGTSSGNQVNLTIRGLRAMDTGLYICKVEQMYPPPYLLGIGNGTQIYVIDPEPCPDSD

SEQ ID NO: 2987 - protein, 126 aa, Artificial Sequence
  L12H/M55T/E59D/L63P/M99L ECD
KAMHVAQPAVVHASSRGIASFVCEYASPGKATEVRVTVLRQADSQVTEVCAATYTMGNDLTFPDDSICTGTSSGNQVNLTIQGLRAMDTGLYICKVELLYPPPYYLGIGNGTQIYVIDPEPCPDSD

SEQ ID NO: 2988 - protein, 126 aa, Artificial Sequence
  I18T/L63P/S72G/L98Q/Y105L/I108V ECD
KAMHVAQPAVVLASSRGTASFVCEYASPGKATEVRVTVLRQADSQVTEVCAATYMMGNELTFPDDSICTGTGSGNQVNLTIQGLRAMDTGLYICKVEQMYPPPYLLGVGNGTQIYVIDPEPCPDSD

SEQ ID NO: 2989 - protein, 126 aa, Artificial Sequence [sequence omitted]

SEQ ID NO: 2990 - protein, 126 aa, Artificial Sequence
  T61A/L63P/S72G/L98Q/M99L/Y105L ECD
KAMHVAQPAVVLASSRGIASFVCEYASPGKATEVRVTVLRQADSQVTEVCAATYMMGNELAFPDDSICTGTGSGNQVNLTIQGLRAMDTGLYICKVEQLYPPPYLLGIGNGTQIYVIDPEPCPDSD

SEQ ID NO: 2991 - protein, 126 aa, Artificial Sequence
  V38I/L63P/S72G/L98Q/M99L/Y105L ECD
KAMHVAQPAVVLASSRGIASFVCEYASPGKATEVRVTILRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 2992 - protein, 126 aa, Artificial Sequence
  L63P/S72G/I93L/L98Q/M99L/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYLCKVEQLYPPPYLLGIGNGTQIYVIDPEPCPDSD

SEQ ID NO: 2993 - protein, 126 aa, Artificial Sequence
  L12I/M55T/M56V/I67T/M99L/L106R/I108F ECD
KAMHVAQPAVVIASSRGIASFVCEYASPGKATEVRVTVLRQADSQVTEVCAATYTVGNELTFLDDSTCTGTSSGNQVNLTIQGLRAMDTGLYICKVELLYPPPYYRGFGNGTQIYVIDPEPCPDSD

SEQ ID NO: 2994 - protein, 126 aa, Artificial Sequence
  I18N/A26T/L63H/T89A/L98Q/M99L/Y105L ECD
KAMHVAQPAVVLASSRGNASFVCEYTSPGKATEVRVTVLRQADSQVTEVCAATYMMGNELTFHDDSICTGTSSGNQVNLTIQGLRAMDAGLYICKVEQLYPPPYLLGIGNGTQIYVIDPEPCPDSD

SEQ ID NO: 2995 - protein, 126 aa, Artificial Sequence
  I18T/E48R/L63P/T69S/L98Q/Y105L/N110Y ECD
KAMHVAQPAVVLASSRGTASFVCEYASPGKATEVRVTVLRQADSQVTRVCAATYMMGNELTFPDDSICSGTSSGNQVNLTIQGLRAMDTGLYICKVEQMYPPPYLLGIGYGTQIYVIDPEPCPDSD

SEQ ID NO: 2996 - protein, 126 aa, Artificial Sequence
  I18N/L63P/S72T/M87T/L98Q/Y105L/N110S ECD
KAMHVAQPAVVLASSRGNASFVCEYASPGKATEVRVTVLRQADSQVTEVCAATYMMGNELTFPDDSICTGTTSGNQVNLTIQGLRATDTGLYICKVEQMYPPPYLLGIGSGTQIYVIDPEPCPDSD

SEQ ID NO: 2997 - protein, 126 aa, Artificial Sequence
  G29W/M56T/L63P/L98Q/Y105L/L106I/I117L ECD
KAMHVAQPAVVLASSRGIASFVCEYASPWKATEVRVTVLRQADSQVTEVCAATYMTGNELTFPDDSICTGTSSGNQVNLTIQGLRAMDTGLYICKVEQMYPPPYLIGIGNGTQIYVLDPEPCPDSD

SEQ ID NO: 2998 - protein, 126 aa, Artificial Sequence
  G29W/N58S/L63P/M87T/L98Q/M99L/Y105L ECD
KAMHVAQPAVVLASSRGIASFVCEYASPWKATEVRVTVLRQADSQVTEVCAATYMMGSELTFPDDSICTGTSSGNQVNLTIQGLRATDTGLYICKVEQLYPPPYLLGIGNGTQIYVIDPEPCPDSD

SEQ ID NO: 2999 - protein, 126 aa, Artificial Sequence
  G29W/N58S/L63P/D64N/L98Q/M99L/Y105L ECD
KAMHVAQPAVVLASSRGIASFVCEYASPWKATEVRVTVLRQADSQVTEVCAATYMMGSELTFPNDSICTGTSSGNQVNLTIQGLRAMDTGLYICKVEQLYPPPYLLGIGNGTQIYVIDPEPCPDSD

SEQ ID NO: 3000 - protein, 126 aa, Artificial Sequence
  I18T/L63P/S72G/M87K/L98Q/M99L/Y105L ECD
KAMHVAQPAVVLASSRGTASFVCEYASPGKATEVRVTVLRQADSQVTEVCAATYMMGNELTFPDDSICTGTGSGNQVNLTIQGLRAKDTGLYICKVEQLYPPPYLLGIGNGTQIYVIDPEPCPDSD

SEQ ID NO: 3001 - protein, 126 aa, Artificial Sequence
  M56V ECD
KAMHVAQPAVVLASSRGIASFVCEYASPGKATEVRVTVLRQADSQVTEVCAATYMVGNELTFLDDSICTGTSSGNQVNLTIQGLRAMDTGLYICKVELMYPPPYYLGIGNGTQIYVIDPEPCPDSD

SEQ ID NO: 3002 - protein, 126 aa, Artificial Sequence
  L63P/K95R ECD
KAMHVAQPAVVLASSRGIASFVCEYASPGKATEVRVTVLRQADSQVTEVCAATYMMGNELTFPDDSICTGTSSGNQVNLTIQGLRAMDTGLYICRVELMYPPPYYLGIGNGTQIYVIDPEPCPDSD

SEQ ID NO: 3003 - protein, 126 aa, Artificial Sequence
  L63P/L98Q ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYYLGIGNGTQIYVIDPEPCPDSD

SEQ ID NO: 3004 - protein, 126 aa, Artificial Sequence
  L98Q/M99L/Y105L ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYLLGIGNGTQIYVIDPEPCPDSD

SEQ ID NO: 3005 - protein, 126 aa, Artificial Sequence
  L63P/M87K/M99L/L106R ECD
KAMHVAQPAVVLASSRGIASFVCEYASPGKATEVRVTVLRQADSQVTEVCAATYMMGNELTFPDDSICTGTSSGNQVNLTIQGLRAKDTGLYICKVELLYPPPYYRGIGNGTQIYVIDPEPCPDSD

SEQ ID NO: 3006 - protein, 126 aa, Artificial Sequence
  L63P/M99L/Y105L/I108F ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVELLYPPPYLLGFGNGTQIYVIDPEPCPDSD

SEQ ID NO: 3007 - protein, 126 aa, Artificial Sequence
  V10A/L63P/L98Q/Y105L ECD
KAMHVAQPAAVLASSRGIASFVCEYASPGKATEVRVTVLRQADSQVTEVCAATYMMGNELTFPDDSICTGTSSGNQVNLTIQGLRAMDTGLYICKVEQMYPPPYLLGIGNGTQIYVIDPEPCPDSD

SEQ ID NO: 3008 - protein, 126 aa, Artificial Sequence
  M56T/L91R/L98Q/Y105L ECD
KAMHVAQPAVVLASSRGIASFVCEYASPGKATEVRVTVLRQADSQVTEVCAATYMTGNELTFLDDSICTGTSSGNQVNLTIQGLRAMDTGRYICKVEQMYPPPYLLGIGNGTQIYVIDPEPCPDSD

SEQ ID NO: 3009 - protein, 126 aa, Artificial Sequence
  A26T/L63P/M87V/N110K/I117E ECD
KAMHVAQPAVVLASSRGIASFVCEYTSPGKATEVRVTVLRQADSQVTEVCAATYMMGNELTFPDDSICTGTSSGNQVNLTIQGLRAVDTGLYICKVELMYPPPYYLGIGKGTQIYVEDPEPCPDSD

SEQ ID NO: 3010 - protein, 126 aa, Artificial Sequence
  G29W/L63P/L98Q/M99L/Y105L ECD
KAMHVAQPAVVLASSRGIASFVCEYASPWKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 3011 - protein, 126 aa, Artificial Sequence
  A26T/V46E/L63P/D65G/L98Q ECD
KAMHVAQPAVVLASSRGIASFVCEYTSPGKATEVRVTVLRQADSQETEVCAATYMMGNELTFPDGSICTGTSSGNQVNLTIQGLRAMDTGLYICKVEQMYPPPYYLGIGNGTQIYVIDPEPCPDSD

SEQ ID NO: 3012 - protein, 126 aa, Artificial Sequence
  G29W/N58S/L63P/L98Q/Y105L ECD
KAMHVAQPAVVLASSRGIASFVCEYASPWKATEVRVTVLRQADSQVTEVCAATYMMGSELTFPDDSICTGTSSGNQVNLTIQGLRAMDTGLYICKVEQMYPPPYLLGIGNGTQIYVIDPEPCPDSD

SEQ ID NO: 3013 - protein, 126 aa, Artificial Sequence
  G29W/E59G/L63P/L98Q/Y105L ECD
KAMHVAQPAVVLASSRGIASFVCEYASPWKATEVRVTVLRQADSQVTEVCAATYMMGNGLTFPDDSICTGTSSGNQVNLTIQGLRAMDTGLYICKVEQMYPPPYLLGIGNGTQIYVIDPEPCPDSD

SEQ ID NO: 3014 - protein, 126 aa, Artificial Sequence
  L12H/L63P/S72G/L98Q/Y105L ECD
KAMHVAQPAVVHASSRGIASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 3015 - protein, 126 aa, Artificial Sequence
  A6T/A26T/M55T/M99L/Y105L ECD
KAMHVTQPAVVLASSRGIASFVCEYTSPGKATEVRVTVLRQADSQVTEVCAATYTMGNELTFLDDSICTGTSSGNQVNLTIQGLRAMDTGLYICKVELLYPPPYLLGIGNGTQIYVIDPEPCPDSD

SEQ ID NO: 3016 - protein, 126 aa, Artificial Sequence
  A26T/L63P/D65G/L98Q/M99L/Y105L ECD
KAMHVAQPAVVLASSRGIASFVCEYTSPGKATEVRVTVLRQADSQVTEVCAATYMMGNELTFPDGSICTGTSSGNQVNLTIQGLRAMDTGLYICKVEQLYPPPYLLGIGNGTQIYVIDPEPCPDSD

SEQ ID NO: 3017 - protein, 126 aa, Artificial Sequence
  V10A/L63P/D64V/S72G/L98Q/M99L/Y105L ECD
KAMHVAQPAAVLASSRGIASFVCEYASPGKATEVRVTVLRQADSQVTEVCAATYMMGNELTFPVDSICTGTGSGNQVNLTIQGLRAMDTGLYICKVEQLYPPPYLLGIGNGTQIYVIDPEPCPDSD

SEQ ID NO: 3018 - protein, 126 aa, Artificial Sequence
  L12P/G29W/D43N/N58S/L63P/L98Q/M99L/Y105L ECD
KAMHVAQPAVVPASSRGIASFVCEYASPWKATEVRVTVLRQANSQVTEVCAATYMMGSELTFPDDSICTGTSSGNQVNLTIQGLRAMDTGLYICKVEQLYPPPYLLGIGNGTQIYVIDPEPCPDSD

SEQ ID NO: 3019 - protein, 126 aa, Artificial Sequence
  I18V/A26T/L63P/D64E/L98Q/Y105L/L106R/N110K ECD
KAMHVAQPAVVLASSRGVASFVCEYTSPGKATEVRVTVLRQADSQVTEVCAATYMMGNELTFPEDSICTGTSSGNQVNLTIQGLRAMDTGLYICKVEQMYPPPYLRGIGKGTQIYVIDPEPCPDSD

SEQ ID NO: 3020 - protein, 126 aa, Artificial Sequence
  A19V/G29W/R35K/L63P/L98Q/M99L/Y105L ECD
KAMHVAQPAVVLASSRGIVSFVCEYASPWKATEVKVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 3021 - protein, 126 aa, Artificial Sequence
  L12P/A26T/L63P/S72G/T89M/L98Q/M99L/Y105L ECD
KAMHVAQPAVVPASSRGIASFVCEYTSPGKATEVRVTVLRQADSQVTEVCAATYMMGNELTFPDDSICTGTGSGNQVNLTIQGLRAMDMGLYICKVEQLYPPPYLLGIGNGTQIYVIDPEPCPDSD

SEQ ID NO: 3022 - protein, 126 aa, Artificial Sequence
  P28L/E33V/L63P/S72G/L98R/M99L/Y105L ECD
KAMHVAQPAVVLASSRGIASFVCEYASLGKATVVRVTVLRQADSQVTEVCAATYMMGNELTFPDDSICTGTGSGNQVNLTIQGLRAMDTGLYICKVERLYPPPYLLGIGNGTQIYVIDPEPCPDSD

SEQ ID NO: 3023 - protein, 126 aa, Artificial Sequence
  E24Q/L63P/S72G/L98Q/M99L/Y105L ECD
KAMHVAQPAVVLASSRGIASFVCQYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 3024 - protein, 126 aa, Artificial Sequence
  I18T/G29R/L63P/S72G/L98Q/M99L/Y105L ECD
KAMHVAQPAVVLASSRGTASFVCEYASPRKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 3025 - protein, 126 aa, Artificial Sequence
  L63P/L98Q/M99L/Y105L ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 3026 - protein, 126 aa, Artificial Sequence
  Q41L/Y54F/M56K/M99L/I108F ECD
KAMHVAQPAVVLASSRGIASFVCEYASPGKATEVRVTVLRLADSQVTEVCAATFMKGNELTFLDDSICTGTSSGNQVNLTIQGLRAMDTGLYICKVELLYPPPYYLGFGNGTQIYVIDPEPCPDSD

SEQ ID NO: 3027 - protein, 126 aa, Artificial Sequence
  S72G/L98Q/M99L/Y105L/I117T ECD
KAMHVAQPAVVLASSRGIASFVCEYASPGKATEVRVTVLRQADSQVTEVCAATYMMGNELTFLDDSICTGTGSGNQVNLTIQGLRAMDTGLYICKVEQLYPPPYLLGIGNGTQIYVTDPEPCPDSD

SEQ ID NO: 3028 - protein, 126 aa, Artificial Sequence
  M56R/L63P/L98Q/M99L/Y105L ECD
KAMHVAQPAVVLASSRGIASFVCEYASPGKATEVRVTVLRQADSQVTEVCAATYMRGNELTFPDDSICTGTSSGNQVNLTIQGLRAMDTGLYICKVEQLYPPPYLLGIGNGTQIYVIDPEPCPDSD

SEQ ID NO: 3029 - protein, 126 aa, Artificial Sequence
  E33M/L63P/S72G/L98Q/Y105L ECD
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 3030 - protein, 126 aa, Artificial Sequence
  L63P/L98Q/M99L/Y105L/L106I ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLIGIGNGTQIYVIDPEPCPDSD

SEQ ID NO: 3031 - protein, 126 aa, Artificial Sequence
  A26T/M55R/L98Q/M99L/Y105L ECD
KAMHVAQPAVVLASSRGIASFVCEYTSPGKATEVRVTVLRQADSQVTEVCAATYRMGNELTFLDDSICTGTSSGNQVNLTIQGLRAMDTGLYICKVEQLYPPPYLLGIGNGTQIYVIDPEPCPDSD

SEQ ID NO: 3032 - protein, 126 aa, Artificial Sequence
  L63P/S72G/M87A/L98Q/Y105L ECD
KAMHVAQPAVVLASSRGIASFVCEYASPGKATEVRVTVLRQADSQVTEVCAATYMMGNELTFPDDSICTGTGSGNQVNLTIQGLRAADTGLYICKVEQMYPPPYLLGIGNGTQIYVIDPEPCPDSD

SEQ ID NO: 3033 - protein, 126 aa, Artificial Sequence
  A26D/S72G/L98Q/M99L/Y105L ECD
KAMHVAQPAVVLASSRGIASFVCEYDSPGKATEVRVTVLRQADSQVTEVCAATYMMGNELTFLDDSICTGTGSGNQVNLTIQGLRAMDTGLYICKVEQLYPPPYLLGIGNGTQIYVIDPEPCPDSD

SEQ ID NO: 3034 - protein, 126 aa, Artificial Sequence
  V22A/L63P/L98Q/M99L/Y105L/P119H ECD
KAMHVAQPAVVLASSRGIASFACEYASPGKATEVRVTVLRQADSQVTEVCAATYMMGNELTFPDDSICTGTSSGNQVNLTIQGLRAMDTGLYICKVEQLYPPPYLLGIGNGTQIYVIDHEPCPDSD

SEQ ID NO: 3035 - protein, 126 aa, Artificial Sequence
  A26T/M55T/L63P/L98Q/M99L/Y105L ECD
KAMHVAQPAVVLASSRGIASFVCEYTSPGKATEVRVTVLRQADSQVTEVCAATYTMGNELTFPDDSICTGTSSGNQVNLTIQGLRAMDTGLYICKVEQLYPPPYLLGIGNGTQIYVIDPEPCPDSD

SEQ ID NO: 3036 - protein, 126 aa, Artificial Sequence
  E33V/A42S/M55T/L98Q/M99L/Y105L ECD
KAMHVAQPAVVLASSRGIASFVCEYASPGKATVVRVTVLRQSDSQVTEVCAATYTMGNELTFLDDSICTGTSSGNQVNLTIQGLRAMDTGLYICKVEQLYPPPYLLGIGNGTQIYVIDPEPCPDSD

SEQ ID NO: 3037 - protein, 126 aa, Artificial Sequence
  G29W/N58S/L63P/Q82R/L98Q/Y105L ECD
KAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSD

SEQ ID NO: 3038 - protein, 126 aa, Artificial Sequence
  E33M/L63P/S72G/L98Q/Y105L/I117L ECD
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGIGNGTQIYVLDPEPCPDSD

SEQ ID NO: 3039 - protein, 126 aa, Artificial Sequence
  A26T/I67N/S72G/L98Q/M99L/Y105L ECD
KAMHVAQPAVVLASSRGIASFVCEYTSPGKATEVRVTVLRQADSQVTEVCAATYMMGNELTFLDDSNCTGTGSGNQVNLTIQGLRAMDTGLYICKVEQLYPPPYLLGIGNGTQIYVIDPEPCPDSD

SEQ ID NO: 3040 - protein, 126 aa, Artificial Sequence
  L12F/A26T/L63P/L98Q/Y105L/L106R ECD
KAMHVAQPAVVFASSRGIASFVCEYTSPGKATEVRVTVLRQADSQVTEVCAATYMMGNELTFPDDSICTGTSSGNQVNLTIQGLRAMDTGLYICKVEQMYPPPYLRGIGNGTQIYVIDPEPCPDSD

SEQ ID NO: 3041 - protein, 126 aa, Artificial Sequence
  S20N/A26T/L63P/L98Q/M99L/Y105L ECD
KAMHVAQPAVVLASSRGIANFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 3042 - protein, 237 aa, Artificial Sequence
  Green fluorescent protein
SKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 3043 - protein, 126 aa, Artificial Sequence
  G29W/T61I/L63P/S72G/L98Q/M99L/Y105L ECD
KAMHVAQPAVVLASSRGIASFVCEYASPWKATEVRVTVLRQADSQVTEVCAATYMMGNELIFPDDSICTGTGSGNQVNLTIQGLRAMDTGLYICKVEQLYPPPYLLGIGNGTQIYVIDPEPCPDSD

SEQ ID NO: 3044 - protein, 126 aa, Artificial Sequence
  G29W/N58S/L63P/T69I/L98Q/M99L/Y105L ECD
KAMHVAQPAVVLASSRGIASFVCEYASPWKATEVRVTVLRQADSQVTEVCAATYMMGSELTFPDDSICIGTSSGNQVNLTIQGLRAMDTGLYICKVEQLYPPPYLLGIGNGTQIYVIDPEPCPDSD

SEQ ID NO: 3045 - protein, 126 aa, Artificial Sequence
  L12P/L63P/S72G/L98Q/M99L/Y105L/L106N ECD
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLNGIGNGTQIYVIDPEPCPDSD

SEQ ID NO: 3046 - protein, 126 aa, Artificial Sequence
  L63P/T69A/L98Q/M99L/Y105L/L106R/V116A ECD
KAMHVAQPAVVLASSRGIASFVCEYASPGKATEVRVTVLRQADSQVTEVCAATYMMGNELTFPDDSICAGTSSGNQVNLTIQGLRAMDTGLYICKVEQLYPPPYLRGIGNGTQIYAIDPEPCPDSD

SEQ ID NO: 3047 - protein, 126 aa, Artificial Sequence
  G29W/N58S/L63P/S72G/L98Q/Y105L ECD
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLLGIGNGTQIYVIDPEPCPDSD

SEQ ID NO: 3048 - protein, 126 aa, Artificial Sequence
  G29W/L63P/D65G/S72G/L98Q/Y105L ECD
KAMHVAQPAVVLASSRGIASFVCEYASPWKATEVRVTVLRQADSQVTEVCAATYMMGNELTFPDGSICTGTGSGNQVNLTIQGLRAMDTGLYICKVEQMYPPPYLLGIGNGTQIYVIDPEPCPDSD

SEQ ID NO: 3049 - protein, 237 aa, Artificial Sequence
  enhanced green fluorescent protein (eEGFP)
SKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 3050 - protein, 126 aa, Artificial Sequence
  T53S/M56V/L98Q/Y105L ECD
KAMHVAQPAVVLASSRGIASFVCEYASPGKATEVRVTVLRQADSQVTEVCAASYMVGNELTFLDDSICTGTSSGNQVNLTIQGLRAMDTGLYICKVEQMYPPPYLLGIGNGTQIYVIDPEPCPDSD

SEQ ID NO: 3051 - protein, 126 aa, Artificial Sequence
  L63P/S72G/L98Q/Y105L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 3052 - protein, 126 aa, Artificial Sequence
  I18A/L63P/S72G/L98Q/Y105L ECD
KAMHVAQPAVVLASSRGAASFVCEYASPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 3053 - protein, 126 aa, Artificial Sequence
  G29W/T53S/M56K/L63P/L98Q/Y105L ECD
KAMHVAQPAVVLASSRGIASFVCEYASPWKATEVRVTVLRQADSQVTEVCAASYMKGNELTFPDDSICTGTSSGNQVNLTIQGLRAMDTGLYICKVEQMYPPPYLLGIGNGTQIYVIDPEPCPDSD

SEQ ID NO: 3054 - protein, 126 aa, Artificial Sequence
  I18V/G29W/L63P/S72G/L98Q/Y105L ECD
KAMHVAQPAVVLASSRGVASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 3055 - protein, 126 aa, Artificial Sequence
  G29W/L63P/S72G/L98Q/Y105L/L106I ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVIDPEPCPDSD

SEQ ID NO: 3056 - protein, 126 aa, Artificial Sequence
  G29W/L63P/I67V/S72G/L98Q/Y105L ECD
KAMHVAQPAVVLASSRGIASFVCEYASPWKATEVRVTVLRQADSQVTEVCAATYMMGNELTFPDDSVCTGTGSGNQVNLTIQGLRAMDTGLYICKVEQMYPPPYLLGIGNGTQIYVIDPEPCPDSD

SEQ ID NO: 3057 - protein, 126 aa, Artificial Sequence
  G29W/M55V/E59G/L63P/L98Q/Y105L ECD
KAMHVAQPAVVLASSRGIASFVCEYASPWKATEVRVTVLRQADSQVTEVCAATYVMGNGLTFPDDSICTGTSSGNQVNLTIQGLRAMDTGLYICKVEQMYPPPYLLGIGNGTQIYVIDPEPCPDSD

SEQ ID NO: 3058 - protein, 126 aa, Artificial Sequence
  G29W/L63P/S72G/L98Q/Y105L/I117L ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVLDPEPCPDSD

SEQ ID NO: 3059 - protein, 126 aa, Artificial Sequence
  L63P/S72G/L98Q/Y105L/L106I/I117L ECD
KAMHVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSD

SEQ ID NO: 3060 - protein, 126 aa, Artificial Sequence
  L12F/R16H/G29W/M56T/L98Q/Y105L ECD
KAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 3061 - protein, 126 aa, Artificial Sequence
  L12P/G29W/L63P/S72G/L98Q/Y105L ECD
KAMHVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 3062 - protein, 126 aa, Artificial Sequence
  L12P/G29W/L63P/S72G/L98Q/Y105L/L106I ECD
KAMHVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVIDPEPCPDSD

SEQ ID NO: 3063 - protein, 126 aa, Artificial Sequence
  G29W/L63P/S72G/L98Q/Y105L/L106I/I117L ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLIGIGNGTQIYVLDPEPCPDSD

SEQ ID NO: 3064 - protein, 126 aa, Artificial Sequence
  G29W/N58S/L63P/S72G/L98Q/Y105L/L106I ECD
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLIGIGNGTQIYVIDPEPCPDSD

SEQ ID NO: 3065 - protein, 126 aa, Artificial Sequence
  A26T/T53S/L63P/L98Q/Y105L/L106I/I117L ECD
KAMHVAQPAVVLASSRGIASFVCEYTSPGKATEVRVTVLRQADSQVTEVCAASYMMGNELTFPDDSICTGTSSGNQVNLTIQGLRAMDTGLYICKVEQMYPPPYLIGIGNGTQIYVLDPEPCPDSD

SEQ ID NO: 3066 - protein, 126 aa, Artificial Sequence
  G29W/N58S/L63P/S72G/M87V/L98Q/Y105L ECD
KAMHVAQPAVVLASSRGIASFVCEYASPWKATEVRVTVLRQADSQVTEVCAATYMMGSELTFPDDSICTGTGSGNQVNLTIQGLRAVDTGLYICKVEQMYPPPYLLGIGNGTQIYVIDPEPCPDSD

SEQ ID NO: 3067 - protein, 126 aa, Artificial Sequence
  G29W/S72G/Q76R/L98Q/Y105L/L106I/Q113H ECD
KAMHVAQPAVVLASSRGIASFVCEYASPWKATEVRVTVLRQADSQVTEVCAATYMMGNELTFLDDSICTGTGSGNRVNLTIQGLRAMDTGLYICKVEQMYPPPYLIGIGNGTHIYVIDPEPCPDSD

SEQ ID NO: 3068 - protein, 126 aa, Artificial Sequence
  G29W/N58S/L63P/S72G/L98Q/Y105L/L106V ECD
KAMHVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYLVGIGNGTQIYVIDPEPCPDSD

SEQ ID NO: 3069 - protein, 126 aa, Artificial Sequence
  A26T/L63P/L98Q/M99L/Y105L ECD
KAMHVAQPAVVLASSRGIASFVCEYTSPGKATEVRVTVLRQADSQVTEVCAATYMMGNELTFPDDSICTGTSSGNQVNLTIQGLRAMDTGLYICKVEQLYPPPYLLGIGNGTQIYVIDPEPCPDSD

SEQ ID NO: 3070 - protein, 126 aa, Artificial Sequence
  G29W/N58D/I67V/L98Q/M99L/Y105L ECD
KAMHVAQPAVVLASSRGIASFVCEYASPWKATEVRVTVLRQADSQVTEVCAATYMMGDELTFLDDSVCTGTSSGNQVNLTIQGLRAMDTGLYICKVEQLYPPPYLLGIGNGTQIYVIDPEPCPDSD

SEQ ID NO: 3071 - protein, 126 aa, Artificial Sequence
  I67V/S72G/Q82H/T89A/L98Q/M99L/Y105L ECD
KAMHVAQPAVVLASSRGIASFVCEYASPGKATEVRVTVLRQADSQVTEVCAATYMMGNELTFLDDSVCTGTGSGNQVNLTIHGLRAMDAGLYICKVEQLYPPPYLLGIGNGTQIYVIDPEPCPDSD

SEQ ID NO: 3072 - protein, 126 aa, Artificial Sequence
  S72G/R85G/L98Q/M99L/Y105L/L106I ECD
KAMHVAQPAVVLASSRGIASFVCEYASPGKATEVRVTVLRQADSQVTEVCAATYMMGNELTFLDDSICTGTGSGNQVNLTIQGLGAMDTGLYICKVEQLYPPPYLIGIGNGTQIYVIDPEPCPDSD

SEQ ID NO: 3073 - protein, 126 aa, Artificial Sequence
  A26T/T47A/M56K/L63P/S72G/Q82R/L98Q/M99L/Y105L ECD
KAMHVAQPAVVLASSRGIASFVCEYTSPGKATEVRVTVLRQADSQVAEVCAATYMKGNELTFPDDSICTGTGSGNQVNLTIRGLRAMDTGLYICKVEQLYPPPYLLGIGNGTQIYVIDPEPCPDSD

SEQ ID NO: 3074 - protein, 126 aa, Artificial Sequence
  A26T/M55T/L63P/S72G/L98Q/M99L/Y105L ECD
KAMHVAQPAVVLASSRGIASFVCEYTSPGKATEVRVTVLRQADSQVTEVCAATYTMGNELTFPDDSICTGTGSGNQVNLTIQGLRAMDTGLYICKVEQLYPPPYLLGIGNGTQIYVIDPEPCPDSD

SEQ ID NO: 3075 - protein, 126 aa, Artificial Sequence
  L12H/I18V/A42T/M55T/N58D/L98R/Y105L/L106I/P121S ECD
KAMHVAQPAVVHASSRGVASFVCEYASPGKATEVRVTVLRQTDSQVTEVCAATYTMGDELTFLDDSICTGTSSGNQVNLTIQGLRAMDTGLYICKVERMYPPPYLIGIGNGTQIYVIDPESCPDSD

SEQ ID NO: 3076 - protein, 126 aa, Artificial Sequence
  I18T/A26T/L63P/S72G/L98Q/Y105L ECD
KAMHVAQPAVVLASSRGTASFVCEYTSPGKATEVRVTVLRQADSQVTEVCAATYMMGNELTFPDDSICTGTGSGNQVNLTIQGLRAMDTGLYICKVEQMYPPPYLLGIGNGTQIYVIDPEPCPDSD

SEQ ID NO: 3077 - protein, 126 aa, Artificial Sequence
  L12F/K30R/S72G/Q82R/L98Q/M99L/Y105L ECD
KAMHVAQPAVVFASSRGIASFVCEYASPGRATEVRVTVLRQADSQVTEVCAATYMMGNELTFLDDSICTGTGSGNQVNLTIRGLRAMDTGLYICKVEQLYPPPYLLGIGNGTQIYVIDPEPCPDSD

SEQ ID NO: 3078 - protein, 126 aa, Artificial Sequence
  L12P/L63P/S72G/L98Q/M99L/Y105L/L106N/I117L ECD
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLNGIGNGTQIYVLDPEPCPDSD

SEQ ID NO: 3079 - protein, 126 aa, Artificial Sequence
  G29W/M87K/I93V/L98Q/M99L/Y105L ECD
KAMHVAQPAVVLASSRGIASFVCEYASPWKATEVRVTVLRQADSQVTEVCAATYMMGNELTFLDDSICTGTSSGNQVNLTIQGLRAKDTGLYVCKVEQLYPPPYLLGIGNGTQIYVIDPEPCPDSD

SEQ ID NO: 3080 - protein, 126 aa, Artificial Sequence
  P28L/E33V/L63P/S72G/L98Q/M99L/Y105L ECD
KAMHVAQPAVVLASSRGIASFVCEYASLGKATVVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 3081 - protein, 126 aa, Artificial Sequence
  G29W/T53S/M56K/L63P/Q82H/L98Q/M99I/Y105L ECD
KAMHVAQPAVVLASSRGIASFVCEYASPWKATEVRVTVLRQADSQVTEVCAASYMKGNELTFPDDSICTGTSSGNQVNLTIHGLRAMDTGLYICKVEQIYPPPYLLGIGNGTQIYVIDPEPCPDSD

SEQ ID NO: 3082 - protein, 126 aa, Artificial Sequence
  I18F/L63P/L98Q/M99L/Y105L/P121S ECD
KAMHVAQPAVVLASSRGFASFVCEYASPGKATEVRVTVLRQADSQVTEVCAATYMMGNELTFPDDSICTGTSSGNQVNLTIQGLRAMDTGLYICKVEQLYPPPYLLGIGNGTQIYVIDPESCPDSD

SEQ ID NO: 3083 - protein, 126 aa, Artificial Sequence
  L63P/L98Q/M99L/Y105L/I108V ECD
KAMHVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYLLGVGNGTQIYVIDPEPCPDSD

SEQ ID NO: 3084 - protein, 126 aa, Artificial Sequence
  A26T/A42V/Q45H/I67N/M87K/E97Q/M99L ECD
KAMHVAQPAVVLASSRGIASFVCEYTSPGKATEVRVTVLRQVDSHVTEVCAATYMMGNELTFLDDSNCTGTSSGNQVNLTIQGLRAKDTGLYICKVQLLYPPPYYLGIGNGTQIYVIDPEPCPDSD

SEQ ID NO: 3085 - protein, 126 aa, Artificial Sequence
  M56V/E59G/L63P/S72G/M87K/I93V/L98Q/M99L/Y105L/I117E ECD
KAMHVAQPAVVLASSRGIASFVCEYASPGKATEVRVTVLRQADSQVTEVCAATYMVGNGLTFPDDSICTGTGSGNQVNLTIQGLRAKDTGLYVCKVEQLYPPPYLLGIGNGTQIYVEDPEPCPDSD

SEQ ID NO: 3086 - protein, 126 aa, Artificial Sequence
  G29W/M87K/T89S/L98Q/M99L/Y105L/I108V/I117L ECD
KAMHVAQPAVVLASSRGIASFVCEYASPWKATEVRVTVLRQADSQVTEVCAATYMMGNELTFLDDSICTGTSSGNQVNLTIQGLRAKDSGLYICKVEQLYPPPYLLGVGNGTQIYVLDPEPCPDSD

SEQ ID NO: 3087 - protein, 126 aa, Artificial Sequence
  L12P/M56V/L63P/V96I/L98Q/M99L/Y105L/Y115H ECD
KAMHVAQPAVVPASSRGIASFVCEYASPGKATEVRVTVLRQADSQVTEVCAATYMVGNELTFPDDSICTGTSSGNQVNLTIQGLRAMDTGLYICKIEQLYPPPYLLGIGNGTQIHVIDPEPCPDSD

SEQ ID NO: 3088 - protein, 126 aa, Artificial Sequence
  G29W/T53S/M56K/T61N/L63P/L98Q/Y105L ECD
KAMHVAQPAVVLASSRGIASFVCEYASPWKATEVRVTVLRQADSQVTEVCAASYMKGNELNFPDDSICTGTSSGNQVNLTIQGLRAMDTGLYICKVEQMYPPPYLLGIGNGTQIYVIDPEPCPDSD

SEQ ID NO: 3089 - protein, 126 aa, Artificial Sequence
  I18T/A26S/M55T/M56V/L63P/S72G/L98Q/M99L/Y105L/I117K ECD
KAMHVAQPAVVLASSRGTASFVCEYSSPGKATEVRVTVLRQADSQVTEVCAATYTVGNELTFPDDSICTGTGSGNQVNLTIQGLRAMDTGLYICKVEQLYPPPYLLGIGNGTQIYVKDPEPCPDSD

SEQ ID NO: 3090 - protein, 126 aa, Artificial Sequence
  I18T/T61R/L63P/S72G/L98Q/M99L/Y105L ECD
KAMHVAQPAVVLASSRGTASFVCEYASPGKATEVRVTVLRQADSQVTEVCAATYMMGNELRFPDDSICTGTGSGNQVNLTIQGLRAMDTGLYICKVEQLYPPPYLLGIGNGTQIYVIDPEPCPDSD

SEQ ID NO: 3091 - protein, 126 aa, Artificial Sequence
  L12P/L63P/S72G/L98Q/M99L/Y105L ECD
KAMHVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYLLGIGNGTQIYVIDPEPCPDSD

SEQ ID NO: 3092 - protein, 126 aa, Artificial Sequence
  E33M/L63P/S72G/L98Q/Y105L/I108F ECD
KAMHVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYLLGFGNGTQIYVIDPEPCPDSD

SEQ ID NO: 3093 - protein, 126 aa, Artificial Sequence
  L12P/R16H/A26T/T61S/L63P/M87V/L98Q/M99L/Y105L/L106I/I117L ECD
KAMHVAQPAVVPASSHGIASFVCEYTSPGKATEVRVTVLRQADSQVTEVCAATYMMGNELSFPDDSICTGTSSGNQVNLTIQGLRAVDTGLYICKVEQLYPPPYLIGIGNGTQIYVLDPEPCPDSD

SEQ ID NO: 3094 - protein, 126 aa, Artificial Sequence
  G29W/T53S/M56K/N58S/L63P/M87V/L98Q/Y105L/P121S ECD
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGIGNGTQIYVIDPESCPDSD

SEQ ID NO: 3095 - protein, 126 aa, Artificial Sequence
  G29W/L63P/S72G/L98Q/Y105L/P121S ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPESCPDSD

SEQ ID NO: 3096 - protein, 126 aa, Artificial Sequence
  G29W/T53S/M56K/N58S/L63P/M87V/L98Q/Y105L ECD
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGIGNGTQIYVIDPEPCPDSD

SEQ ID NO: 3097 - protein, 126 aa, Artificial Sequence
  G29W/T53S/M56K/N58S/L63P/M87V/L98Q/Y105L/I108V ECD
KAMHVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYLLGVGNGTQIYVIDPEPCPDSD

SEQ ID NO: 3098 - protein, 126 aa, Artificial Sequence
  G29W/T53S/L63P/S72G/L98Q/Y105L ECD
KAMHVAQPAVVLASSRGIASFVCEYASPWKATEVRVTVLRQADSQVTEVCAASYMMGNELTFPDDSICTGTGSGNQVNLTIQGLRAMDTGLYICKVEQMYPPPYLLGIGNGTQIYVIDPEPCPDSD

SEQ ID NO: 3099 - protein, 126 aa, Artificial Sequence
  V10A/G29W/T53S/M56K/L63P/L98Q/Y105L/P121S ECD
KAMHVAQPAAVLASSRGIASFVCEYASPWKATEVRVTVLRQADSQVTEVCAASYMKGNELTFPDDSICTGTSSGNQVNLTIQGLRAMDTGLYICKVEQMYPPPYLLGIGNGTQIYVIDPESCPDSD

SEQ ID NO: 3100 - protein, 102 aa, Artificial Sequence
  L12P/A26T/L63P/L98Q/Y105L IgV
HVAQPAVVPASSRGIASFVCEYTSPGKATEVRVTVLRQADSQVTEVCAATYMMGNELTFPDDSICTGTSSGNQVNLTIQGLRAMDTGLYICKVEQMYPPPYL

SEQ ID NO: 3101 - protein, 102 aa, Artificial Sequence
  L63P/L98R IgV domain (of L63P/L98R/N110K - IgV doesn't contain N110 residue)
HVAQPAVVLASSRGIASFVCEYASPGKATEVRVTVLRQADSQVTEVCAATYMMGNELTFPDDSICTGTSSGNQVNLTIQGLRAMDTGLYICKVERMYPPPYY

SEQ ID NO: 3102 - protein, 102 aa, Artificial Sequence
  L12P/A26T IgV domain
HVAQPAVVPASSRGIASFVCEYTSPGKATEVRVTVLRQADSQVTEVCAATYMMGNELTFLDDSICTGTSSGNQVNLTIQGLRAMDTGLYICKVELMYPPPYY

SEQ ID NO: 3103 - protein, 102 aa, Artificial Sequence
  L12P/A26T/L63P IgV domain
HVAQPAVVPASSRGIASFVCEYTSPGKATEVRVTVLRQADSQVTEVCAATYMMGNELTFPDDSICTGTSSGNQVNLTIQGLRAMDTGLYICKVELMYPPPYY

SEQ ID NO: 3104 - protein, 102 aa, Artificial Sequence
  L63P/L98Q/Y105L IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYL

SEQ ID NO: 3105 - protein, 102 aa, Artificial Sequence
  L98Q/Y105L IgV domain
HVAQPAVVLASSRGIASFVCEYASPGKATEVRVTVLRQADSQVTEVCAATYMMGNELTFLDDSICTGTSSGNQVNLTIQGLRAMDTGLYICKVEQMYPPPYL

SEQ ID NO: 3106 - protein, 102 aa, Artificial Sequence
  L63P IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVELMYPPPYY

SEQ ID NO: 3107 - protein, 102 aa, Artificial Sequence
  L98R IgV domain (of L98R/N110K - IgV doesn't contain N110 residue)
HVAQPAVVLASSRGIASFVCEYASPGKATEVRVTVLRQADSQVTEVCAATYMMGNELTFLDDSICTGTSSGNQVNLTIQGLRAMDTGLYICKVERMYPPPYY

SEQ ID NO: 3108 - protein, 102 aa, Artificial Sequence
  L12P/A26T/L63P/L98Q/M99L/Y105L IgV domain
HVAQPAVVPASSRGIASFVCEYTSPGKATEVRVTVLRQADSQVTEVCAATYMMGNELTFPDDSICTGTSSGNQVNLTIQGLRAMDTGLYICKVEQLYPPPYL

SEQ ID NO: 3109 - protein, 102 aa, Artificial Sequence
  E33M/Q82H/L98Q/M99L/Y105L IgV domain
HVAQPAVVLASSRGIASFVCEYASPGKATMVRVTVLRQADSQVTEVCAATYMMGNELTFLDDSICTGTSSGNQVNLTIHGLRAMDTGLYICKVEQLYPPPYL

SEQ ID NO: 3110 - protein, 102 aa, Artificial Sequence
  L63P/S72G/L98Q/M99L/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYICKVEQLYPPPYL

SEQ ID NO: 3111 - protein, 102 aa, Artificial Sequence
  S14N/R16C/I18T/M56K/T61A/L63P/A86T/M99L IgV domain
HVAQPAVVLANSCGTASFVCEYASPGKATEVRVTVLRQADSQVTEVCAATYMKGNELAFPDDSICTGTSSGNQVNLTIQGLRTMDTGLYICKVELLYPPPYY

SEQ ID NO: 3112 - protein, 102 aa, Artificial Sequence
  S27P/M56K/L63P/S72G/S73R/T89A/M99L/Y105L IgV domain
HVAQPAVVLASSRGIASFVCEYAPPGKATEVRVTVLRQADSQVTEVCAATYMKGNELTFPDDSICTGTGRGNQVNLTIQGLRAMDAGLYICKVELLYPPPYL

SEQ ID NO: 3113 - protein, 102 aa, Artificial Sequence
  M56K/L63P/N75D/V96I/M99L/Y105L IgV domain
HVAQPAVVLASSRGIASFVCEYASPGKATEVRVTVLRQADSQVTEVCAATYMKGNELTFPDDSICTGTSSGDQVNLTIQGLRAMDTGLYICKIELLYPPPYL

SEQ ID NO: 3114 - protein, 102 aa, Artificial Sequence
  L63P/S72G/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYICKVELMYPPPYL

SEQ ID NO: 3115 - protein, 102 aa, Artificial Sequence
  A26T/L63P/S72G/L98Q/Y105L IgV domain
HVAQPAVVLASSRGIASFVCEYTSPGKATEVRVTVLRQADSQVTEVCAATYMMGNELTFPDDSICTGTGSGNQVNLTIQGLRAMDTGLYICKVEQMYPPPYL

SEQ ID NO: 3116 - protein, 102 aa, Artificial Sequence
  G29W/L98Q/M99L/Y105L IgV domain
HVAQPAVVLASSRGIASFVCEYASPWKATEVRVTVLRQADSQVTEVCAATYMMGNELTFLDDSICTGTSSGNQVNLTIQGLRAMDTGLYICKVEQLYPPPYL

SEQ ID NO: 3117 - protein, 102 aa, Artificial Sequence
  T37S/M56V/L98Q/Y105L IgV domain
HVAQPAVVLASSRGIASFVCEYASPGKATEVRVSVLRQADSQVTEVCAATYMVGNELTFLDDSICTGTSSGNQVNLTIQGLRAMDTGLYICKVEQMYPPPYL

SEQ ID NO: 3118 - protein, 102 aa, Artificial Sequence
  A26T/Y54F/M56K/M99L/Y105L IgV domain
HVAQPAVVLASSRGIASFVCEYTSPGKATEVRVTVLRQADSQVTEVCAATFMKGNELTFLDDSICTGTSSGNQVNLTIQGLRAMDTGLYICKVELLYPPPYL

SEQ ID NO: 3119 - protein, 102 aa, Artificial Sequence
  L12P/I18T/A26T/M55T/T69S/S72G/M99L/Y105L IgV domain
HVAQPAVVPASSRGTASFVCEYTSPGKATEVRVTVLRQADSQVTEVCAATYTMGNELTFLDDSICSGTGSGNQVNLTIQGLRAMDTGLYICKVELLYPPPYL

SEQ ID NO: 3120 - protein, 102 aa, Artificial Sequence
  V22I/L63P/L98Q/Y105L IgV domain
HVAQPAVVLASSRGIASFICEYASPGKATEVRVTVLRQADSQVTEVCAATYMMGNELTFPDDSICTGTSSGNQVNLTIQGLRAMDTGLYICKVEQMYPPPYL

SEQ ID NO: 3121 - protein, 102 aa, Artificial Sequence
  A26T/L63P/S72G/L98Q/M99L/Y105L IgV domain
HVAQPAVVLASSRGIASFVCEYTSPGKATEVRVTVLRQADSQVTEVCAATYMMGNELTFPDDSICTGTGSGNQVNLTIQGLRAMDTGLYICKVEQLYPPPYL

SEQ ID NO: 3122 - protein, 102 aa, Artificial Sequence
  E33M/A42T/L98Q/Y105L IgV domain
HVAQPAVVLASSRGIASFVCEYASPGKATMVRVTVLRQTDSQVTEVCAATYMMGNELTFLDDSICTGTSSGNQVNLTIQGLRAMDTGLYICKVEQMYPPPYL

SEQ ID NO: 3123 - protein, 102 aa, Artificial Sequence
  M55T/E97Q/M99L/Y105F IgV domain
HVAQPAVVLASSRGIASFVCEYASPGKATEVRVTVLRQADSQVTEVCAATYTMGNELTFLDDSICTGTSSGNQVNLTIQGLRAMDTGLYICKVQLLYPPPYF

SEQ ID NO: 3124 - protein, 102 aa, Artificial Sequence
  M55T/S72G/L98Q/M99L/Y105L IgV domain
HVAQPAVVLASSRGIASFVCEYASPGKATEVRVTVLRQADSQVTEVCAATYTMGNELTFLDDSICTGTGSGNQVNLTIQGLRAMDTGLYICKVEQLYPPPYL

SEQ ID NO: 3125 - protein, 102 aa, Artificial Sequence
  R16C/G29W/E33V/M55T/L63P/L98Q/Y105L IgV domain
HVAQPAVVLASSCGIASFVCEYASPWKATVVRVTVLRQADSQVTEVCAATYTMGNELTFPDDSICTGTSSGNQVNLTIQGLRAMDTGLYICKVEQMYPPPYL

SEQ ID NO: 3126 - protein, 102 aa, Artificial Sequence
  M56L/L63P/L98Q/Y105L IgV domain
HVAQPAVVLASSRGIASFVCEYASPGKATEVRVTVLRQADSQVTEVCAATYMLGNELTFPDDSICTGTSSGNQVNLTIQGLRAMDTGLYICKVEQMYPPPYL

SEQ ID NO: 3127 - protein, 102 aa, Artificial Sequence
  S15P/I18V/M56T/L98Q/M99L/Y105L IgV domain
HVAQPAVVLASPRGVASFVCEYASPGKATEVRVTVLRQADSQVTEVCAATYMTGNELTFLDDSICTGTSSGNQVNLTIQGLRAMDTGLYICKVEQLYPPPYL

SEQ ID NO: 3128 - protein, 102 aa, Artificial Sequence
  I18T/G29W/L63P/L98Q/Y105L IgV domain
HVAQPAVVLASSRGTASFVCEYASPWKATEVRVTVLRQADSQVTEVCAATYMMGNELTFPDDSICTGTSSGNQVNLTIQGLRAMDTGLYICKVEQMYPPPYL

SEQ ID NO: 3129 - protein, 102 aa, Artificial Sequence
  L63P/Q82H/L98Q/M99L/Y105L IgV domain
HVAQPAVVLASSRGIASFVCEYASPGKATEVRVTVLRQADSQVTEVCAATYMMGNELTFPDDSICTGTSSGNQVNLTIHGLRAMDTGLYICKVEQLYPPPYL

SEQ ID NO: 3130 - protein, 102 aa, Artificial Sequence
  M55T/L63P/T71I/M99L/Y105L IgV domain
HVAQPAVVLASSRGIASFVCEYASPGKATEVRVTVLRQADSQVTEVCAATYTMGNELTFPDDSICTGISSGNQVNLTIQGLRAMDTGLYICKVELLYPPPYL

SEQ ID NO: 3131 - protein, 102 aa, Artificial Sequence
  A26T/T53S/M56K/L63P/L98Q/Y105L IgV domain
HVAQPAVVLASSRGIASFVCEYTSPGKATEVRVTVLRQADSQVTEVCAASYMKGNELTFPDDSICTGTSSGNQVNLTIQGLRAMDTGLYICKVEQMYPPPYL

SEQ ID NO: 3132 - protein, 102 aa, Artificial Sequence
  I18T/A26T/L63P/Q82R/L98Q/Y105L IgV domain
HVAQPAVVLASSRGTASFVCEYTSPGKATEVRVTVLRQADSQVTEVCAATYMMGNELTFPDDSICTGTSSGNQVNLTIRGLRAMDTGLYICKVEQMYPPPYL

SEQ ID NO: 3133 - protein, 102 aa, Artificial Sequence
  L12H/M55T/E59D/L63P/M99L IgV domain
HVAQPAVVHASSRGIASFVCEYASPGKATEVRVTVLRQADSQVTEVCAATYTMGNDLTFPDDSICTGTSSGNQVNLTIQGLRAMDTGLYICKVELLYPPPYY

SEQ ID NO: 3134 - protein, 102 aa, Artificial Sequence
  I18T/L63P/S72G/L98Q/Y105L IgV domain
HVAQPAVVLASSRGTASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 3135 - protein, 102 aa, Artificial Sequence
  I18T/L63P/S72G/L98Q/M99L/Y105L IgV domain
HVAQPAVVLASSRGTASFVCEYASPGKATEVRVTVLRQADSQVTEVCAATYMMGNELTFPDDSICTGTGSGNQVNLTIQGLRAMDTGLYICKVEQLYPPPYL

SEQ ID NO: 3136 - protein, 102 aa, Artificial Sequence
  T61A/L63P/S72G/L98Q/M99L/Y105L IgV domain
HVAQPAVVLASSRGIASFVCEYASPGKATEVRVTVLRQADSQVTEVCAATYMMGNELAFPDDSICTGTGSGNQVNLTIQGLRAMDTGLYICKVEQLYPPPYL

SEQ ID NO: 3137 - protein, 102 aa, Artificial Sequence
  V38I/L63P/S72G/L98Q/M99L/Y105L IgV domain
HVAQPAVVLASSRGIASFVCEYASPGKATEVRVTILRQADSQVTEVCAATYMMGNELTFPDDSICTGTGSGNQVNLTIQGLRAMDTGLYICKVEQLYPPPYL

SEQ ID NO: 3138 - protein, 102 aa, Artificial Sequence
  L63P/S72G/I93L/L98Q/M99L/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYLCKVEQLYPPPYL

SEQ ID NO: 3139 - protein, 102 aa, Artificial Sequence
  L12I/M55T/M56V/I67T/M99L IgV domain
HVAQPAVVIASSRGIASFVCEYASPGKATEVRVTVLRQADSQVTEVCAATYTVGNELTFLDDSTCTGTSSGNQVNLTIQGLRAMDTGLYICKVELLYPPPYY

SEQ ID NO: 3140 - protein, 102 aa, Artificial Sequence
  I18N/A26T/L63H/T89A/L98Q/M99L/Y105L IgV domain
HVAQPAVVLASSRGNASFVCEYTSPGKATEVRVTVLRQADSQVTEVCAATYMMGNELTFHDDSICTGTSSGNQVNLTIQGLRAMDAGLYICKVEQLYPPPYL

SEQ ID NO: 3141 - protein, 102 aa, Artificial Sequence
  I18T/E48R/L63P/T69S/L98Q/Y105L IgV domain
HVAQPAVVLASSRGTASFVCEYASPGKATEVRVTVLRQADSQVTRVCAATYMMGNELTFPDDSICSGTSSGNQVNLTIQGLRAMDTGLYICKVEQMYPPPYL

SEQ ID NO: 3142 - protein, 102 aa, Artificial Sequence
  I18N/L63P/S72T/M87T/L98Q/Y105L IgV domain
HVAQPAVVLASSRGNASFVCEYASPGKATEVRVTVLRQADSQVTEVCAATYMMGNELTFPDDSICTGTTSGNQVNLTIQGLRATDTGLYICKVEQMYPPPYL

SEQ ID NO: 3143 - protein, 102 aa, Artificial Sequence
  G29W/M56T/L63P/L98Q/Y105L IgV domain
HVAQPAVVLASSRGIASFVCEYASPWKATEVRVTVLRQADSQVTEVCAATYMTGNELTFPDDSICTGTSSGNQVNLTIQGLRAMDTGLYICKVEQMYPPPYL

SEQ ID NO: 3144 - protein, 102 aa, Artificial Sequence
  G29W/N58S/L63P/M87T/L98Q/M99L/Y105L IgV domain
HVAQPAVVLASSRGIASFVCEYASPWKATEVRVTVLRQADSQVTEVCAATYMMGSELTFPDDSICTGTSSGNQVNLTIQGLRATDTGLYICKVEQLYPPPYL

SEQ ID NO: 3145 - protein, 102 aa, Artificial Sequence
  G29W/N58S/L63P/D64N/L98Q/M99L/Y105L IgV domain
HVAQPAVVLASSRGIASFVCEYASPWKATEVRVTVLRQADSQVTEVCAATYMMGSELTFPNDSICTGTSSGNQVNLTIQGLRAMDTGLYICKVEQLYPPPYL

SEQ ID NO: 3146 - protein, 102 aa, Artificial Sequence
  I18T/L63P/S72G/M87K/L98Q/M99L/Y105L IgV domain
HVAQPAVVLASSRGTASFVCEYASPGKATEVRVTVLRQADSQVTEVCAATYMMGNELTFPDDSICTGTGSGNQVNLTIQGLRAKDTGLYICKVEQLYPPPYL

SEQ ID NO: 3147 - protein, 102 aa, Artificial Sequence
  M56V IgV domain
HVAQPAVVLASSRGIASFVCEYASPGKATEVRVTVLRQADSQVTEVCAATYMVGNELTFLDDSICTGTSSGNQVNLTIQGLRAMDTGLYICKVELMYPPPYY

SEQ ID NO: 3148 - protein, 102 aa, Artificial Sequence
  L63P/K95R IgV domain
HVAQPAVVLASSRGIASFVCEYASPGKATEVRVTVLRQADSQVTEVCAATYMMGNELTFPDDSICTGTSSGNQVNLTIQGLRAMDTGLYICRVELMYPPPYY

SEQ ID NO: 3149 - protein, 102 aa, Artificial Sequence
  L63P/L98Q IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVEQMYPPPYY

SEQ ID NO: 3150 - protein, 102 aa, Artificial Sequence
  L98Q/M99L/Y105L IgV domain
HVAQPAVVLASSRGIASFVCEYASPGKATEVRVTVLRQADSQVTEVCAATYMMGNELTFLDDSICTGTSSGNQVNLTIQGLRAMDTGLYICKVEQLYPPPYL

SEQ ID NO: 3151 - protein, 102 aa, Artificial Sequence
  L63P/M87K/M99L IgV domain
HVAQPAVVLASSRGIASFVCEYASPGKATEVRVTVLRQADSQVTEVCAATYMMGNELTFPDDSICTGTSSGNQVNLTIQGLRAKDTGLYICKVELLYPPPYY

SEQ ID NO: 3152 - protein, 102 aa, Artificial Sequence
  L63P/M99L/Y105L IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVELLYPPPYL

SEQ ID NO: 3153 - protein, 102 aa, Artificial Sequence
  V10A/L63P/L98Q/Y105L IgV domain
HVAQPAAVLASSRGIASFVCEYASPGKATEVRVTVLRQADSQVTEVCAATYMMGNELTFPDDSICTGTSSGNQVNLTIQGLRAMDTGLYICKVEQMYPPPYL

SEQ ID NO: 3154 - protein, 102 aa, Artificial Sequence
  M56T/L91R/L98Q/Y105L IgV domain
HVAQPAVVLASSRGIASFVCEYASPGKATEVRVTVLRQADSQVTEVCAATYMTGNELTFLDDSICTGTSSGNQVNLTIQGLRAMDTGRYICKVEQMYPPPYL

SEQ ID NO: 3155 - protein, 102 aa, Artificial Sequence
  A26T/L63P/M87V IgV domain
HVAQPAVVLASSRGIASFVCEYTSPGKATEVRVTVLRQADSQVTEVCAATYMMGNELTFPDDSICTGTSSGNQVNLTIQGLRAVDTGLYICKVELMYPPPYY

SEQ ID NO: 3156 - protein, 102 aa, Artificial Sequence
  G29W/L63P/L98Q/M99L/Y105L IgV domain
HVAQPAVVLASSRGIASFVCEYASPWKATEVRVTVLRQADSQVTEVCAATYMMGNELTFPDDSICTGTSSGNQVNLTIQGLRAMDTGLYICKVEQLYPPPYL

SEQ ID NO: 3157 - protein, 102 aa, Artificial Sequence
  A26T/V46E/L63P/D65G/L98Q IgV domain
HVAQPAVVLASSRGIASFVCEYTSPGKATEVRVTVLRQADSQETEVCAATYMMGNELTFPDGSICTGTSSGNQVNLTIQGLRAMDTGLYICKVEQMYPPPYY

SEQ ID NO: 3158 - protein, 102 aa, Artificial Sequence
  G29W/N58S/L63P/L98Q/Y105L IgV domain
HVAQPAVVLASSRGIASFVCEYASPWKATEVRVTVLRQADSQVTEVCAATYMMGSELTFPDDSICTGTSSGNQVNLTIQGLRAMDTGLYICKVEQMYPPPYL

SEQ ID NO: 3159 - protein, 102 aa, Artificial Sequence
  G29W/E59G/L63P/L98Q/Y105L IgV domain
HVAQPAVVLASSRGIASFVCEYASPWKATEVRVTVLRQADSQVTEVCAATYMMGNGLTFPDDSICTGTSSGNQVNLTIQGLRAMDTGLYICKVEQMYPPPYL

SEQ ID NO: 3160 - protein, 102 aa, Artificial Sequence
  L12H/L63P/S72G/L98Q/Y105L IgV domain
HVAQPAVVHASSRGIASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 3161 - protein, 102 aa, Artificial Sequence
  A6T/A26T/M55T/M99L/Y105L IgV domain
HVTQPAVVLASSRGIASFVCEYTSPGKATEVRVTVLRQADSQVTEVCAATYTMGNELTFLDDSICTGTSSGNQVNLTIQGLRAMDTGLYICKVELLYPPPYL

SEQ ID NO: 3162 - protein, 102 aa, Artificial Sequence
  A26T/L63P/D65G/L98Q/M99L/Y105L IgV domain
HVAQPAVVLASSRGIASFVCEYTSPGKATEVRVTVLRQADSQVTEVCAATYMMGNELTFPDGSICTGTSSGNQVNLTIQGLRAMDTGLYICKVEQLYPPPYL

SEQ ID NO: 3163 - protein, 102 aa, Artificial Sequence
  V10A/L63P/D64V/S72G/L98Q/M99L/Y105L IgV domain
HVAQPAAVLASSRGIASFVCEYASPGKATEVRVTVLRQADSQVTEVCAATYMMGNELTFPVDSICTGTGSGNQVNLTIQGLRAMDTGLYICKVEQLYPPPYL

SEQ ID NO: 3164 - protein, 102 aa, Artificial Sequence
  L12P/G29W/D43N/N58S/L63P/L98Q/M99L/Y105L IgV domain
HVAQPAVVPASSRGIASFVCEYASPWKATEVRVTVLRQANSQVTEVCAATYMMGSELTFPDDSICTGTSSGNQVNLTIQGLRAMDTGLYICKVEQLYPPPYL

SEQ ID NO: 3165 - protein, 102 aa, Artificial Sequence
  I18V/A26T/L63P/D64E/L98Q/Y105L IgV domain
HVAQPAVVLASSRGVASFVCEYTSPGKATEVRVTVLRQADSQVTEVCAATYMMGNELTFPEDSICTGTSSGNQVNLTIQGLRAMDTGLYICKVEQMYPPPYL

SEQ ID NO: 3166 - protein, 102 aa, Artificial Sequence
  A19V/G29W/R35K/L63P/L98Q/M99L/Y105L IgV domain
HVAQPAVVLASSRGIVSFVCEYASPWKATEVKVTVLRQADSQVTEVCAATYMMGNELTFPDDSICTGTSSGNQVNLTIQGLRAMDTGLYICKVEQLYPPPYL

SEQ ID NO: 3167 - protein, 102 aa, Artificial Sequence
  L12P/A26T/L63P/S72G/T89M/L98Q/M99L/Y105L IgV domain
HVAQPAVVPASSRGIASFVCEYTSPGKATEVRVTVLRQADSQVTEVCAATYMMGNELTFPDDSICTGTGSGNQVNLTIQGLRAMDMGLYICKVEQLYPPPYL

SEQ ID NO: 3168 - protein, 102 aa, Artificial Sequence
  P28L/E33V/L63P/S72G/L98R/M99L/Y105L IgV domain
HVAQPAVVLASSRGIASFVCEYASLGKATVVRVTVLRQADSQVTEVCAATYMMGNELTFPDDSICTGTGSGNQVNLTIQGLRAMDTGLYICKVERLYPPPYL

SEQ ID NO: 3169 - protein, 102 aa, Artificial Sequence
  E24Q/L63P/S72G/L98Q/M99L/Y105L IgV domain
HVAQPAVVLASSRGIASFVCQYASPGKATEVRVTVLRQADSQVTEVCAATYMMGNELTFPDDSICTGTGSGNQVNLTIQGLRAMDTGLYICKVEQLYPPPYL

SEQ ID NO: 3170 - protein, 102 aa, Artificial Sequence
  I18T/G29R/L63P/S72G/L98Q/M99L/Y105L IgV domain
HVAQPAVVLASSRGTASFVCEYASPRKATEVRVTVLRQADSQVTEVCAATYMMGNELTFPDDSICTGTGSGNQVNLTIQGLRAMDTGLYICKVEQLYPPPYL

SEQ ID NO: 3171 - protein, 102 aa, Artificial Sequence
  L63P/L98Q/M99L/Y105L IgV domain
HVAQPAVVLASSRGIASFVCEYASPGKATEVRVTVLRQADSQVTEVCAATYMMGNELTFPDDSICTGTSSGNQVNLTIQGLRAMDTGLYICKVEQLYPPPYL

SEQ ID NO: 3172 - protein, 102 aa, Artificial Sequence
  Q41L/Y54F/M56K/M99L IgV domain
HVAQPAVVLASSRGIASFVCEYASPGKATEVRVTVLRLADSQVTEVCAATFMKGNELTFLDDSICTGTSSGNQVNLTIQGLRAMDTGLYICKVELLYPPPYY

SEQ ID NO: 3173 - protein, 102 aa, Artificial Sequence
  S72G/L98Q/M99L/Y105L IgV domain
HVAQPAVVLASSRGIASFVCEYASPGKATEVRVTVLRQADSQVTEVCAATYMMGNELTFLDDSICTGTGSGNQVNLTIQGLRAMDTGLYICKVEQLYPPPYL

SEQ ID NO: 3174 - protein, 102 aa, Artificial Sequence
  M56R/L63P/L98Q/M99L/Y105L IgV domain
HVAQPAVVLASSRGIASFVCEYASPGKATEVRVTVLRQADSQVTEVCAATYMRGNELTFPDDSICTGTSSGNQVNLTIQGLRAMDTGLYICKVEQLYPPPYL

SEQ ID NO: 3175 - protein, 102 aa, Artificial Sequence
  E33M/L63P/S72G/L98Q/Y105L IgV domain
HVAQPAVVLASSRGIASFVCEYASPGKATMVRVTVLRQADSQVTEVCAATYMMGNELTFPDDSICTGTGSGNQVNLTIQGLRAMDTGLYICKVEQMYPPPYL

SEQ ID NO: 3176 - protein, 102 aa, Artificial Sequence
  A26T/M55R/L98Q/M99L/Y105L IgV domain
HVAQPAVVLASSRGIASFVCEYTSPGKATEVRVTVLRQADSQVTEVCAATYRMGNELTFLDDSICTGTSSGNQVNLTIQGLRAMDTGLYICKVEQLYPPPYL

SEQ ID NO: 3177 - protein, 102 aa, Artificial Sequence
  L63P/S72G/M87A/L98Q/Y105L IgV domain
HVAQPAVVLASSRGIASFVCEYASPGKATEVRVTVLRQADSQVTEVCAATYMMGNELTFPDDSICTGTGSGNQVNLTIQGLRAADTGLYICKVEQMYPPPYL

SEQ ID NO: 3178 - protein, 102 aa, Artificial Sequence
  A26D/S72G/L98Q/M99L/Y105L IgV domain
HVAQPAVVLASSRGIASFVCEYDSPGKATEVRVTVLRQADSQVTEVCAATYMMGNELTFLDDSICTGTGSGNQVNLTIQGLRAMDTGLYICKVEQLYPPPYL

SEQ ID NO: 3179 - protein, 102 aa, Artificial Sequence
  V22A/L63P/L98Q/M99L/Y105L IgV domain
HVAQPAVVLASSRGIASFACEYASPGKATEVRVTVLRQADSQVTEVCAATYMMGNELTFPDDSICTGTSSGNQVNLTIQGLRAMDTGLYICKVEQLYPPPYL

SEQ ID NO: 3180 - protein, 102 aa, Artificial Sequence
  A26T/M55T/L63P/L98Q/M99L/Y105L IgV domain
HVAQPAVVLASSRGIASFVCEYTSPGKATEVRVTVLRQADSQVTEVCAATYTMGNELTFPDDSICTGTSSGNQVNLTIQGLRAMDTGLYICKVEQLYPPPYL

SEQ ID NO: 3181 - protein, 102 aa, Artificial Sequence
  E33V/A42S/M55T/L98Q/M99L/Y105L IgV domain
HVAQPAVVLASSRGIASFVCEYASPGKATVVRVTVLRQSDSQVTEVCAATYTMGNELTFLDDSICTGTSSGNQVNLTIQGLRAMDTGLYICKVEQLYPPPYL

SEQ ID NO: 3182 - protein, 102 aa, Artificial Sequence
  G29W/N58S/L63P/Q82R/L98Q/Y105L IgV domain
HVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYL

SEQ ID NO: 3183 - protein, 102 aa, Artificial Sequence
  A26T/I67N/S72G/L98Q/M99L/Y105L IgV domain
HVAQPAVVLASSRGIASFVCEYTSPGKATEVRVTVLRQADSQVTEVCAATYMMGNELTFLDDSNCTGTGSGNQVNLTIQGLRAMDTGLYICKVEQLYPPPYL

SEQ ID NO: 3184 - protein, 102 aa, Artificial Sequence
  L12F/A26T/L63P/L98Q/Y105L IgV domain
HVAQPAVVFASSRGIASFVCEYTSPGKATEVRVTVLRQADSQVTEVCAATYMMGNELTFPDDSICTGTSSGNQVNLTIQGLRAMDTGLYICKVEQMYPPPYL

SEQ ID NO: 3185 - protein, 102 aa, Artificial Sequence
  S20N/A26T/L63P/L98Q/M99L/Y105L IgV domain
HVAQPAVVLASSRGIANFVCEYTSPGKATEVRVTVLRQADSQVTEVCAATYMMGNELTFPDDSICTGTSSGNQVNLTIQGLRAMDTGLYICKVEQLYPPPYL

SEQ ID NO: 3186 - protein, 102 aa, Artificial Sequence
  G29W/M87K/T89S/L98Q/M99L/Y105L IgV domain
HVAQPAVVLASSRGIASFVCEYASPWKATEVRVTVLRQADSQVTEVCAATYMMGNELTFLDDSICTGTSSGNQVNLTIQGLRAKDSGLYICKVEQLYPPPYL

SEQ ID NO: 3187 - protein, 102 aa, Artificial Sequence
  G29W/T61I/L63P/S72G/L98Q/M99L/Y105L IgV domain
HVAQPAVVLASSRGIASFVCEYASPWKATEVRVTVLRQADSQVTEVCAATYMMGNELIFPDDSICTGTGSGNQVNLTIQGLRAMDTGLYICKVEQLYPPPYL

SEQ ID NO: 3188 - protein, 102 aa, Artificial Sequence
  G29W/N58S/L63P/T69I/L98Q/M99L/Y105L IgV domain
HVAQPAVVLASSRGIASFVCEYASPWKATEVRVTVLRQADSQVTEVCAATYMMGSELTFPDDSICIGTSSGNQVNLTIQGLRAMDTGLYICKVEQLYPPPYL

SEQ ID NO: 3189 - protein, 102 aa, Artificial Sequence
  L12P/L63P/S72G/L98Q/M99L/Y105L IgV domain
HVAQPAVVPASSRGIASFVCEYASPGKATEVRVTVLRQADSQVTEVCAATYMMGNELTFPDDSICTGTGSGNQVNLTIQGLRAMDTGLYICKVEQLYPPPYL

SEQ ID NO: 3190 - protein, 102 aa, Artificial Sequence
  L63P/T69A/L98Q/M99L/Y105L IgV domain
HVAQPAVVLASSRGIASFVCEYASPGKATEVRVTVLRQADSQVTEVCAATYMMGNELTFPDDSICAGTSSGNQVNLTIQGLRAMDTGLYICKVEQLYPPPYL

SEQ ID NO: 3191 - protein, 102 aa, Artificial Sequence
  G29W/N58S/L63P/S72G/L98Q/Y105L IgV domain
HVAQPAVVLASSRGIASFVCEYASPWKATEVRVTVLRQADSQVTEVCAATYMMGSELTFPDDSICTGTGSGNQVNLTIQGLRAMDTGLYICKVEQMYPPPYL

SEQ ID NO: 3192 - protein, 102 aa, Artificial Sequence
  G29W/L63P/D65G/S72G/L98Q/Y105L IgV domain
HVAQPAVVLASSRGIASFVCEYASPWKATEVRVTVLRQADSQVTEVCAATYMMGNELTFPDGSICTGTGSGNQVNLTIQGLRAMDTGLYICKVEQMYPPPYL

SEQ ID NO: 3193 - protein, 102 aa, Artificial Sequence
  T53S/M56V/L98Q/Y105L IgV domain
HVAQPAVVLASSRGIASFVCEYASPGKATEVRVTVLRQADSQVTEVCAASYMVGNELTFLDDSICTGTSSGNQVNLTIQGLRAMDTGLYICKVEQMYPPPYL

SEQ ID NO: 3194 - protein, 102 aa, Artificial Sequence
  L63P/S72G/L98Q/Y105L IgV domain
HVAQPAVVLASSRGIASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 3195 - protein, 102 aa, Artificial Sequence
  I18A/L63P/S72G/L98Q/Y105L IgV domain
HVAQPAVVLASSRGAASFVCEYASPGKATEVRVTVLRQADSQVTEVCAATYMMGNELTFPDDSICTGTGSGNQVNLTIQGLRAMDTGLYICKVEQMYPPPYL

SEQ ID NO: 3196 - protein, 102 aa, Artificial Sequence
  G29W/T53S/M56K/L63P/L98Q/Y105L IgV domain
HVAQPAVVLASSRGIASFVCEYASPWKATEVRVTVLRQADSQVTEVCAASYMKGNELTFPDDSICTGTSSGNQVNLTIQGLRAMDTGLYICKVEQMYPPPYL

SEQ ID NO: 3197 - protein, 102 aa, Artificial Sequence
  I18V/G29W/L63P/S72G/L98Q/Y105L IgV domain
HVAQPAVVLASSRGVASFVCEYASPWKATEVRVTVLRQADSQVTEVCAATYMMGNELTFPDDSICTGTGSGNQVNLTIQGLRAMDTGLYICKVEQMYPPPYL

SEQ ID NO: 3198 - protein, 102 aa, Artificial Sequence
  G29W/L63P/S72G/L98Q/Y105L IgV domain
HVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYL

SEQ ID NO: 3199 - protein, 102 aa, Artificial Sequence
  G29W/L63P/I67V/S72G/L98Q/Y105L IgV domain
HVAQPAVVLASSRGIASFVCEYASPWKATEVRVTVLRQADSQVTEVCAATYMMGNELTFPDDSVCTGTGSGNQVNLTIQGLRAMDTGLYICKVEQMYPPPYL

SEQ ID NO: 3200 - protein, 102 aa, Artificial Sequence
  G29W/M55V/E59G/L63P/L98Q/Y105L IgV domain
HVAQPAVVLASSRGIASFVCEYASPWKATEVRVTVLRQADSQVTEVCAATYVMGNGLTFPDDSICTGTSSGNQVNLTIQGLRAMDTGLYICKVEQMYPPPYL

SEQ ID NO: 3201 - protein, 102 aa, Artificial Sequence
  L12F/R16H/G29W/M56T/L98Q/Y105L IgV domain
HVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYL

SEQ ID NO: 3202 - protein, 102 aa, Artificial Sequence
  L12P/G29W/L63P/S72G/L98Q/Y105L IgV domain
HVAQPAVVPASSRGIASFVCEYASPWKATEVRVTVLRQADSQVTEVCAATYMMGNELTFPDDSICTGTGSGNQVNLTIQGLRAMDTGLYICKVEQMYPPPYL

SEQ ID NO: 3203 - protein, 102 aa, Artificial Sequence
  A26T/T53S/L63P/L98Q/Y105L IgV domain
HVAQPAVVLASSRGIASFVCEYTSPGKATEVRVTVLRQADSQVTEVCAASYMMGNELTFPDDSICTGTSSGNQVNLTIQGLRAMDTGLYICKVEQMYPPPYL

SEQ ID NO: 3204 - protein, 102 aa, Artificial Sequence
  G29W/N58S/L63P/S72G/M87V/L98Q/Y105L IgV domain
HVAQPAVVLASSRGIASFVCEYASPWKATEVRVTVLRQADSQVTEVCAATYMMGSELTFPDDSICTGTGSGNQVNLTIQGLRAVDTGLYICKVEQMYPPPYL

SEQ ID NO: 3205 - protein, 102 aa, Artificial Sequence
  G29W/S72G/Q76R/L98Q/Y105L IgV domain
HVAQPAVVLASSRGIASFVCEYASPWKATEVRVTVLRQADSQVTEVCAATYMMGNELTFLDDSICTGTGSGNRVNLTIQGLRAMDTGLYICKVEQMYPPPYL

SEQ ID NO: 3206 - protein, 102 aa, Artificial Sequence
  A26T/L63P/L98Q/M99L/Y105L IgV domain
HVAQPAVVLASSRGIASFVCEYTSPGKATEVRVTVLRQADSQVTEVCAATYMMGNELTFPDDSICTGTSSGNQVNLTIQGLRAMDTGLYICKVEQLYPPPYL

SEQ ID NO: 3207 - protein, 102 aa, Artificial Sequence
  G29W/N58D/I67V/L98Q/M99L/Y105L IgV domain
HVAQPAVVLASSRGIASFVCEYASPWKATEVRVTVLRQADSQVTEVCAATYMMGDELTFLDDSVCTGTSSGNQVNLTIQGLRAMDTGLYICKVEQLYPPPYL

SEQ ID NO: 3208 - protein, 102 aa, Artificial Sequence
  I67V/S72G/Q82H/T89A/L98Q/M99L/Y105L IgV domain
HVAQPAVVLASSRGIASFVCEYASPGKATEVRVTVLRQADSQVTEVCAATYMMGNELTFLDDSVCTGTGSGNQVNLTIHGLRAMDAGLYICKVEQLYPPPYL

SEQ ID NO: 3209 - protein, 102 aa, Artificial Sequence
  S72G/R85G/L98Q/M99L/Y105L IgV domain
HVAQPAVVLASSRGIASFVCEYASPGKATEVRVTVLRQADSQVTEVCAATYMMGNELTFLDDSICTGTGSGNQVNLTIQGLGAMDTGLYICKVEQLYPPPYL

SEQ ID NO: 3210 - protein, 102 aa, Artificial Sequence
  A26T/T47A/M56K/L63P/S72G/Q82R/L98Q/M99L/Y105L IgV domain
HVAQPAVVLASSRGIASFVCEYTSPGKATEVRVTVLRQADSQVAEVCAATYMKGNELTFPDDSICTGTGSGNQVNLTIRGLRAMDTGLYICKVEQLYPPPYL

SEQ ID NO: 3211 - protein, 102 aa, Artificial Sequence
  A26T/M55T/L63P/S72G/L98Q/M99L/Y105L IgV domain
HVAQPAVVLASSRGIASFVCEYTSPGKATEVRVTVLRQADSQVTEVCAATYTMGNELTFPDDSICTGTGSGNQVNLTIQGLRAMDTGLYICKVEQLYPPPYL

SEQ ID NO: 3212 - protein, 102 aa, Artificial Sequence
  L12H/I18V/A42T/M55T/N58D/L98R/Y105L IgV domain
HVAQPAVVHASSRGVASFVCEYASPGKATEVRVTVLRQTDSQVTEVCAATYTMGDELTFLDDSICTGTSSGNQVNLTIQGLRAMDTGLYICKVERMYPPPYL

SEQ ID NO: 3213 - protein, 102 aa, Artificial Sequence
  I18T/A26T/L63P/S72G/L98Q/Y105L IgV domain
HVAQPAVVLASSRGTASFVCEYTSPGKATEVRVTVLRQADSQVTEVCAATYMMGNELTFPDDSICTGTGSGNQVNLTIQGLRAMDTGLYICKVEQMYPPPYL

SEQ ID NO: 3214 - protein, 102 aa, Artificial Sequence
  L12F/K30R/S72G/Q82R/L98Q/M99L/Y105L IgV domain
HVAQPAVVFASSRGIASFVCEYASPGRATEVRVTVLRQADSQVTEVCAATYMMGNELTFLDDSICTGTGSGNQVNLTIRGLRAMDTGLYICKVEQLYPPPYL

SEQ ID NO: 3215 - protein, 102 aa, Artificial Sequence
  G29W/M87K/I93V/L98Q/M99L/Y105L IgV domain
HVAQPAVVLASSRGIASFVCEYASPWKATEVRVTVLRQADSQVTEVCAATYMMGNELTFLDDSICTGTSSGNQVNLTIQGLRAKDTGLYVCKVEQLYPPPYL

SEQ ID NO: 3216 - protein, 102 aa, Artificial Sequence
  P28L/E33V/L63P/S72G/L98Q/M99L/Y105L IgV domain
HVAQPAVVLASSRGIASFVCEYASLGKATVVRVTVLRQADSQVTEVCAATYMMGNELTFPDDSICTGTGSGNQVNLTIQGLRAMDTGLYICKVEQLYPPPYL

SEQ ID NO: 3217 - protein, 102 aa, Artificial Sequence
  G29W/T53S/M56K/L63P/Q82H/L98Q/M99I/Y105L IgV domain
HVAQPAVVLASSRGIASFVCEYASPWKATEVRVTVLRQADSQVTEVCAASYMKGNELTFPDDSICTGTSSGNQVNLTIHGLRAMDTGLYICKVEQIYPPPYL

SEQ ID NO: 3218 - protein, 102 aa, Artificial Sequence
  I18F/L63P/L98Q/M99L/Y105L IgV domain
HVAQPAVVLASSRGFASFVCEYASPGKATEVRVTVLRQADSQVTEVCAATYMMGNELTFPDDSICTGTSSGNQVNLTIQGLRAMDTGLYICKVEQLYPPPYL

SEQ ID NO: 3219 - protein, 102 aa, Artificial Sequence
  A26T/A42V/Q45H/I67N/M87K/E97Q/M99L IgV domain
HVAQPAVVLASSRGIASFVCEYTSPGKATEVRVTVLRQVDSHVTEVCAATYMMGNELTFLDDSNCTGTSSGNQVNLTIQGLRAKDTGLYICKVQLLYPPPYY

SEQ ID NO: 3220 - protein, 102 aa, Artificial Sequence
  M56V/E59G/L63P/S72G/M87K/I93V/L98Q/M99L/Y105L IgV domain
HVAQPAVVLASSRGIASFVCEYASPGKATEVRVTVLRQADSQVTEVCAATYMVGNGLTFPDDSICTGTGSGNQVNLTIQGLRAKDTGLYVCKVEQLYPPPYL

SEQ ID NO: 3221 - protein, 102 aa, Artificial Sequence
  L12P/M56V/L63P/V96I/L98Q/M99L/Y105L IgV domain
HVAQPAVVPASSRGIASFVCEYASPGKATEVRVTVLRQADSQVTEVCAATYMVGNELTFPDDSICTGTSSGNQVNLTIQGLRAMDTGLYICKIEQLYPPPYL

SEQ ID NO: 3222 - protein, 102 aa, Artificial Sequence
  G29W/T53S/M56K/T61N/L63P/L98Q/Y105L IgV domain
HVAQPAVVLASSRGIASFVCEYASPWKATEVRVTVLRQADSQVTEVCAASYMKGNELNFPDDSICTGTSSGNQVNLTIQGLRAMDTGLYICKVEQMYPPPYL

SEQ ID NO: 3223 - protein, 102 aa, Artificial Sequence
  I18T/A26S/M55T/M56V/L63P/S72G/L98Q/M99L/Y105L IgV domain
HVAQPAVVLASSRGTASFVCEYSSPGKATEVRVTVLRQADSQVTEVCAATYTVGNELTFPDDSICTGTGSGNQVNLTIQGLRAMDTGLYICKVEQLYPPPYL

SEQ ID NO: 3224 - protein, 102 aa, Artificial Sequence
  I18T/T61R/L63P/S72G/L98Q/M99L/Y105L IgV domain
HVAQPAVVLASSRGTASFVCEYASPGKATEVRVTVLRQADSQVTEVCAATYMMGNELRFPDDSICTGTGSGNQVNLTIQGLRAMDTGLYICKVEQLYPPPYL

SEQ ID NO: 3225 - protein, 102 aa, Artificial Sequence; identical to SEQ ID NO: 3189
  L12P/L63P/S72G/L98Q/M99L/Y105L IgV domain

SEQ ID NO: 3226 - protein, 102 aa, Artificial Sequence
  L12P/R16H/A26T/T61S/L63P/M87V/L98Q/M99L/Y105L IgV domain
HVAQPAVVPASSHGIASFVCEYTSPGKATEVRVTVLRQADSQVTEVCAATYMMGNELSFPDDSICTGTSSGNQVNLTIQGLRAVDTGLYICKVEQLYPPPYL

SEQ ID NO: 3227 - protein, 102 aa, Artificial Sequence
  G29W/T53S/M56K/N58S/L63P/M87V/L98Q/Y105L IgV domain
HVAQPAVVLASSRGIASFVCEYASPWKATEVRVTVLRQADSQVTEVCAASYMKGSELTFPDDSICTGTSSGNQVNLTIQGLRAVDTGLYICKVEQMYPPPYL

SEQ ID NO: 3228 - protein, 102 aa, Artificial Sequence
  G29W/T53S/L63P/S72G/L98Q/Y105L IgV domain
HVAQPAVVLASSRGIASFVCEYASPWKATEVRVTVLRQADSQVTEVCAASYMMGNELTFPDDSICTGTGSGNQVNLTIQGLRAMDTGLYICKVEQMYPPPYL

SEQ ID NO: 3229 - protein, 102 aa, Artificial Sequence
  V10A/G29W/T53S/M56K/L63P/L98Q/Y105L IgV domain
HVAQPAAVLASSRGIASFVCEYASPWKATEVRVTVLRQADSQVTEVCAASYMKGNELTFPDDSICTGTSSGNQVNLTIQGLRAMDTGLYICKVEQMYPPPYL

SEQ ID NO: 3230 - protein, 126 aa, Artificial Sequence
  CTLA-4 ECD
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSD

SEQ ID NO: 3231 - protein, 126 aa, Artificial Sequence
  CTLA-4 ECD
KAMHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPSPDSD

SEQ ID NO: 3232 - protein, 102 aa, Artificial Sequence
  CTLA-4 IgV
HVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYY

SEQ ID NO: 3233 - protein, 111 aa, Homo sapiens
  MISC_FEATURE: CD8B IgV
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQL

SEQ ID NO: 3234 - DNA, 2580 bp, Artificial Sequence
  Anti-CD3 - PD-L1 303 - PD-L1 303 - PD-L1 303 - Fc
caggtccagctgcagcagtctggggctgaactggcaagacctggggcctcagtgaagatgtcctgcaaggcttctggctacacctttactaggtacacgatgcactgggtaaaacagaggcctggacagggtctggaatggattggatacattaatcctagccgtggttatactaattacaatcagaagttcaaggacaaggccacattgactacagacaaatcctccagcacagcctacatgcaactgagcagcctgacatctgaggactctgcagtctattactgtgcaagatattatgatgatcattactgccttgactactggggccaaggcaccacggtgaccgtgagcgccgggggaggtggcagcgggggaggtggcagcggcggcgggagctcccaaattgttctcacccagtctccagcaatcatgtctgcatctccaggggagaaggtcaccatgacctgcagtgccagctcaagtgtaagttacatgaactggtaccagcagaagtcaggcacctcccccaaaagatggatttatgacacatccaaactggcttctggagtccctgctcacttcaggggcagtgggtctgggacctcttactctctcacaatcagcggcatggaggctgaagatgctgccacttattactgccagcagtggagtagtaacccattcacgttcggctcggggacaaagttggaaataaaccggggcggtggcgatcccggtggaggagggtcaagcgcttttacagtaaccgtaccgaaggacctttacgtcgttgagtatggatctaatatgactattgagtgtaaatttcccgttgagaaacagcttgacctggcggcgctcatcgtgtattgggaaatggaagggaaagacattatacaattcgttcatggagaggaagatcagaaagcccaacactcttcttatcgacaaagggcacggttgctgaaagatcaattgtcattgggaaacgctgcattgcaaattactgacgtgaagctccaggacgcaggtgtatacaggtgcatgattagttacggtggaggagcggactataagcggataaccgtaaaggttaacgcaggtggtggagggtcaggcggaggaggatcttttacggttacagtcccgaaagacctctatgtcgtcgaatacggatcaaatatgacgatcgagtgcaaatttcctgtcgagaaacagctggaccttgcggctttgatagtatactgggagatggaaggaaaggacattatccaattcgtgcacggcgaagaggaccagaaggcgcaacattcttcatacaggcagcgggctaggcttctcaaagatcaattgagtctcggcaacgcagcactgcaaattaccgatgtcaagttgcaggacgctggcgtctatcgctgcatgataagctatggcggtggtgcggactataaacgaattacggtgaaggtgaatgcaggtggcggcgggagcggcggtggagggagttttacagttacggtcccaaaggatctttatgtggttgaatatggttcaaacatgaccatcgagtgtaagttcccggtcgagaagcaactcgacttggctgcgttgattgtatactgggagatggagggaaaggacattattcagtttgtccatggggaggaagatcaaaaagctcagcacagctcatatcggcagcgggcccgactgttgaaagaccagttgagtttggggaacgcggctcttcagataactgatgttaagcttcaggacgcaggagtgtataggtgcatgataagttatggcgggggagccgattataaacggataaccgtaaaagttaatgctggcggcggaggttcaggcggaggtggcagcgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggaag

SEQ ID NO: 3235 - DNA, 2205 bp, Artificial Sequence
  IL16 - PD-L1 303 - PD-L1 303 - PD-L1 303 - Fc
agcgccgcttctgcctcagcagccagcgatgtctctgtcgaaagcacggcggaagctactgtttgtactgtcacccttgagaaaatgagcgcgggtttggggttttcactcgagggcggcaaagggtcacttcacggcgacaaaccattgacaatcaatcggatatttaaaggtgctgcctctgaacagagcgaaactgttcaaccgggcgatgaaatactgcaactgggtggtacagccatgcagggcctgacgcgcttcgaggcgtggaacattataaaagcactgcctgatggtccagtcacaatagtcatccgccggaaatcacttcaatcaaaggagaccaccgctgcgggagacagcggtggaggagggtcaagcgcttttacagtaaccgtaccgaaggacctttacgtcgttgagtatggatctaatatgactattgagtgtaaatttcccgttgagaaacagcttgacctggcggcgctcatcgtgtattgggaaatggaagggaaagacattatacaattcgttcatggagaggaagatcagaaagcccaacactcttcttatcgacaaagggcacggttgctgaaagatcaattgtcattgggaaacgctgcattgcaaattactgacgtgaagctccaggacgcaggtgtatacaggtgcatgattagttacggtggaggagcggactataagcggataaccgtaaaggttaacgcaggtggtggagggtcaggcggaggaggatcttttacggttacagtcccgaaagacctctatgtcgtcgaatacggatcaaatatgacgatcgagtgcaaatttcctgtcgagaaacagctggaccttgcggctttgatagtatactgggagatggaaggaaaggacattatccaattcgtgcacggcgaagaggaccagaaggcgcaacattcttcatacaggcagcgggctaggcttctcaaagatcaattgagtctcggcaacgcagcactgcaaattaccgatgtcaagttgcaggacgctggcgtctatcgctgcatgataagctatggcggtggtgcggactataaacgaattacggtgaaggtgaatgcaggtggcggcgggagcggcggtggagggagttttacagttacggtcccaaaggatctttatgtggttgaatatggttcaaacatgaccatcgagtgtaagttcccggtcgagaagcaactcgacttggctgcgttgattgtatactgggagatggagggaaaggacattattcagtttgtccatggggaggaagatcaaaaagctcagcacagctcatatcggcagcgggcccgactgttgaaagaccagttgagtttggggaacgcggctcttcagataactgatgttaagcttcaggacgcaggagtgtataggtgcatgataagttatggcgggggagccgattataaacggataaccgtaaaagttaatgctggcggcggaggttcaggcggaggtggcagcgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggaag

SEQ ID NO: 3236 - DNA, 2223 bp, Artificial Sequence
  CTLA-4 2519 - PD-L1 303 - PD-L1 303 - PD-L1 303 - Fc
aaggcgatgcacgtagcccagcccgctgttgttctcgcaagttctcgcggcatagcctccttcgtatgtgagtatgccagtccaggtaagtacacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatgaaggcattggaaatggaacacaaatctatgttattgacccggagccgtgtccagatagtgatcagggtggaggagggtcaagcgcttttacagtaaccgtaccgaaggacctttacgtcgttgagtatggatctaatatgactattgagtgtaaatttcccgttgagaaacagcttgacctggcggcgctcatcgtgtattgggaaatggaagggaaagacattatacaattcgttcatggagaggaagatcagaaagcccaacactcttcttatcgacaaagggcacggttgctgaaagatcaattgtcattgggaaacgctgcattgcaaattactgacgtgaagctccaggacgcaggtgtatacaggtgcatgattagttacggtggaggagcggactataagcggataaccgtaaaggttaacgcaggtggtggagggtcaggcggaggaggatcttttacggttacagtcccgaaagacctctatgtcgtcgaatacggatcaaatatgacgatcgagtgcaaatttcctgtcgagaaacagctggaccttgcggctttgatagtatactgggagatggaaggaaaggacattatccaattcgtgcacggcgaagaggaccagaaggcgcaacattcttcatacaggcagcgggctaggcttctcaaagatcaattgagtctcggcaacgcagcactgcaaattaccgatgtcaagttgcaggacgctggcgtctatcgctgcatgataagctatggcggtggtgcggactataaacgaattacggtgaaggtgaatgcaggtggcggcgggagcggcggtggagggagttttacagttacggtcccaaaggatctttatgtggttgaatatggttcaaacatgaccatcgagtgtaagttcccggtcgagaagcaactcgacttggctgcgttgattgtatactgggagatggagggaaaggacattattcagtttgtccatggggaggaagatcaaaaagctcagcacagctcatatcggcagcgggcccgactgttgaaagaccagttgagtttggggaacgcggctcttcagataactgatgttaagcttcaggacgcaggagtgtataggtgcatgataagttatggcgggggagccgattataaacggataaccgtaaaagttaatgctggcggcggaggttcaggcggaggtggcagcgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggaag

SEQ ID NO: 3237 - protein, 250 aa, Homo sapiens
  MISC_FEATURE: LFA-3
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 3238 - protein, 222 aa, Homo sapiens
  MISC_FEATURE: Mature LFA-3
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 3239 - protein, 187 aa, Homo sapiens
  MISC_FEATURE: LFA-3 ECD
FSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHR

SEQ ID NO: 3240 - protein, 5 aa, Artificial Sequence
  EAAAK Linker
EAAAK

SEQ ID NO: 3241 - protein, 15 aa, Artificial Sequence
  3x EAAAK Linker
EAAAKEAAAKEAAAK

SEQ ID NO: 3242 - protein, 25 aa, Artificial Sequence
  5x EAAAK Linker
EAAAKEAAAKEAAAKEAAAKEAAAK

SEQ ID NO: 3243 - protein, 239 aa, Artificial Sequence
  eGFP
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 3244 - protein, 208 aa, Artificial Sequence
  CD80 v1 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3245 - protein, 208 aa, Artificial Sequence
  CD80 v2 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3246 - protein, 208 aa, Artificial Sequence
  CD80 v3 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEAPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3247 - protein, 208 aa, Artificial Sequence
  CD80 v4 ECD
VIHMTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3248 - protein, 208 aa, Artificial Sequence
  CD80 v5 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3249 - protein, 208 aa, Artificial Sequence
  CD80 v6 ECD
VIHVTKEVKEVATLSCGHNLSVEELAQTRIYWQKEKKMVLTMMSGDMNIWPEYKNRTIFDITNNLSIVIQALRPSDEGTYECVVLKYEKDSFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3250 - protein, 208 aa, Artificial Sequence
  CD80 v7 ECD
VIHVTKEVKEVATLSCGHNVSVEELAQTRIYWQKEKKMVLTMMPGDMNIWPEYKNRTIFDITNNLSIVIQALRPSDEGTYECVVLKYEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3251 - protein, 208 aa, Artificial Sequence
  CD80 v8 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFGIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3252 - protein, 208 aa, Artificial Sequence
  CD80 v9 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3253 - protein, 208 aa, Artificial Sequence
  CD80 v10 ECD
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3254 - protein, 208 aa, Artificial Sequence
  CD80 v11 ECD
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVTLSVKADFPTPSISDFEIPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 3255 - protein, 208 aa, Artificial Sequence
  CD80 v12 ECD
VIHVTKEVKEVATLSCGHNVSVEELAQTRIYWQKEKKMVLTMMSGDMNIWPEYKNRTIFDITNNLSIVIQALRPSDEGTYECVVLKNEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3256 - protein, 208 aa, Artificial Sequence
  CD80 v13 ECD
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3257 - protein, 208 aa, Artificial Sequence
  CD80 v14 ECD
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3258 - protein, 208 aa, Artificial Sequence
  CD80 v15 ECD
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVTLSVKADFPTPSISDFEIPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 3259 - protein, 208 aa, Artificial Sequence
  CD80 v16 ECD
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3260 - protein, 208 aa, Artificial Sequence
  CD80 v17 ECD
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3261 - protein, 208 aa, Artificial Sequence
  CD80 v18 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLPVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3262 - protein, 208 aa, Artificial Sequence
  CD80 v19 ECD
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3263 - protein, 208 aa, Artificial Sequence
  CD80 v20 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3264 - protein, 208 aa, Artificial Sequence
  CD80 v21 ECD
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3265 - protein, 208 aa, Artificial Sequence
  CD80 v22 ECD
VIHVTKEVKEVATLSCGHNVSVEELAQTRIYWQKEKKMVLTMMSGDMNIWPEYMNRTIFDITNNLSIVILALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3266 - protein, 208 aa, Artificial Sequence
  CD80 v23 ECD
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVTLSVKADFPTPSISDFEIPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 3267 - protein, 208 aa, Artificial Sequence
  CD80 v24 ECD
VIHVTKEVKEVATLSCGHNVSVEELAQTHIYWQKEKKMVLTMMSGDMNIWPGYKNRTIFDITNNLSIVIRALRPSDEGTYECVVLKYGKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3268 - protein, 208 aa, Artificial Sequence
  CD80 v25 ECD
VIHVTKEVKEVATLSCGHNVSVEELAQTRIHWQKEKKMVLGMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3269 - protein, 208 aa, Artificial Sequence
  CD80 v26 ECD
VIHVTKEVKEVATLSCGHNVSVEELAQTRIYWQKEKKMVLTMMSGDMNIWPEYKNRTIFDITNNLSIAILALRPSDEGTYECVVLKYEKDAFKREHLAEVTLSVKADFPAPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3270 - protein, 208 aa, Artificial Sequence
  CD80 v27 ECD
VIHVTKEVKEVATLSCGHNVSVEELAQTRIYWQKEKKMVLTMMSGDMNIWPEYKNRTIFDITNNLHIVILALRPSDEGTYECVVLKYEKGAFKREHLAEVTLSVKADFPAPSISDLEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3271 - protein, 208 aa, Artificial Sequence
  CD80 v28 ECD
VIHVTKEVKEVATLSCGHNVSVEELAQTHIYWQKEKKMVLTMMSGDMNIWPGYKNRTIFDITNNLSIVILALRPSDEGTYECVVLKYEKDAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3272 - protein, 208 aa, Artificial Sequence
  CD80 v29 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTSSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3273 - protein, 208 aa, Artificial Sequence
  CD80 v30 ECD
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3274 - protein, 208 aa, Artificial Sequence
  CD80 v31 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPAPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3275 - protein, 208 aa, Artificial Sequence
  CD80 v32 ECD
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3276 - protein, 208 aa, Artificial Sequence
  CD80 v33 ECD
VIHVTKEVKEVATLSCGHNVSAEELAQTRIYWQKEKKMVLTMMSGDMNIWPEYKNRTIFDITNNLSIVIQALRPSDEGTYECVVLKYEKDAFKREHLAEVTLSVKADFPTPSISDFEIPTPNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3277 - protein, 208 aa, Artificial Sequence
  CD80 v34 ECD
VIHVTKEVKEVVTLFCGHNVSVEELAQTRIHWQKEKKMVLGMMSGDMNIWPEYKNRTIFDITNNLSIVILALRPSDEGTYECVVLKYEKDAFKREHLAEVTLSVKADFPTPSISDFEIPTSNIRRIICSASGGFPELHLSWLENGEELNAITTTVSQDPETELYAVSSKLDFNMTTNHSFMCLIKYGHLRVNQTFNWNTTKQEHFPDN

SEQ ID NO: 3278 - protein, 208 aa, Artificial Sequence
  CD80 v35 ECD
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3279 - protein, 208 aa, Artificial Sequence
  CD80 v36 ECD
VIHVTKEVKEVATLSCGHNVSVEGPAQTRIYWQKEKKMVLTMMSGDMNIWPEYKNRTIFDITNNLSIVIQALRPSDEGTYECVVLKYEKDAFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3280 - protein, 208 aa, Artificial Sequence
  CD80 v37 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVTLSVKADLPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3281 - protein, 208 aa, Artificial Sequence
  CD80 v38 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 3282 - protein, 208 aa, Artificial Sequence
  CD80 v39 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLESGEELSAINTTVSQDPETELYAVSSKLDFNMTTNHSFMCLIKYGHLRVNQTFNWNTTKQEHFPDN

SEQ ID NO: 3283 - protein, 208 aa, Artificial Sequence
  CD80 v40 ECD
VIHVTKEVKEVATLSCGHNVSVEELAQTDILWHKEGKIVLATRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLENGEESSAINTTVSQDPETELYAVSSKLDFNMTTNHSFMCLIKYGHLRVNQTFNWNTTKQEHFPDN

SEQ ID NO: 3284 - protein, 208 aa, Artificial Sequence
  CD80 v41 ECD
VIHVTKEVKEVATLSCGHNVSVEGLAQTDILWHKEGKIVLAMRSGDTNIWPEYKNRTILDITNNLSIVILALRPSDEGTYVCVVRKYENDTPVLERLAEVTLSVKADFPTPSISDFEIPTSNIRRIICSTSGGFPEPHLSWLENGEELSAINTTVSQDPETELYAVSSKLDFNMTTNHSFMSLIKYGHLRVNQTFNWNTTKQEHFPDN

SEQ ID NO: 3285 - protein, 208 aa, Artificial Sequence
  CD80 v42 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 3286 - protein, 208 aa, Artificial Sequence
  CD80 v43 ECD
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3287 - protein, 208 aa, Artificial Sequence
  CD80 v44 ECD
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3288 - protein, 208 aa, Artificial Sequence
  CD80 v45 ECD
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKADFPTPSISDFEIPTSSIRRIICSTSGGFPEPHLSWLENGEELNAINTTVSQDPETELYAVSSKLDFNMTTSHSFMCLIKYGHLRVNQTFNWNTTKQEHFPDN

SEQ ID NO: 3289 - protein, 208 aa, Artificial Sequence
  CD80 v46 ECD
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3290 - protein, 208 aa, Artificial Sequence
  CD80 v47 ECD
VIHVTKEVKEVATLSCGHNVSVEELAQTRIYWQKEGQIVLTMMSGDMNIWPEYKNRTILDITNNLSIVILALRPSDEGTYVCVVRKYENDTPVLEHLAGVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 3291 - protein, 208 aa, Artificial Sequence
  CD80 v48 ECD
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3292 - protein, 208 aa, Artificial Sequence
  CD80 v49 ECD
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3293 - protein, 208 aa, Artificial Sequence
  CD80 v50 ECD
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3294 - protein, 208 aa, Artificial Sequence
  CD80 v51 ECD
VIHVTKEVKEVATLSCGHNVSVEELAQTHIHWQKEKKMVLGMMSGDMNIWPEYKNRTIFDITNNLSIVILALRPSDEGTYECVVLKNGENGFKREHLAEVTLSVKADFSTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3295 - protein, 208 aa, Artificial Sequence
  CD80 v52 ECD
VIHVTKEVKEVTTLSCGLNVSVEELAQTRIYWQKEKKMVLTMVSGDMNIWPEYKNRTILDITNNLSIVILALRPSDKGTYECVVLKYEKDAFKREHLAEVTLSVKADFSTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3296 - protein, 208 aa, Artificial Sequence
  CD80 v53 ECD
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3297 - protein, 208 aa, Artificial Sequence
  CD80 v54 ECD
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3298 - protein, 101 aa, Artificial Sequence; identical to SEQ ID NO: 1005
  CD80 WT IgV

SEQ ID NO: 3299 - protein, 101 aa, Artificial Sequence
  CD80 v1 IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVT

SEQ ID NO: 3300 - protein, 101 aa, Artificial Sequence
  CD80 v20 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVT

SEQ ID NO: 3301 - protein, 101 aa, Artificial Sequence
  CD80 v6 IgV
VIHVTKEVKEVATLSCGHNLSVEELAQTRIYWQKEKKMVLTMMSGDMNIWPEYKNRTIFDITNNLSIVIQALRPSDEGTYECVVLKYEKDSFKREHLAEVT

SEQ ID NO: 3302 - protein, 101 aa, Artificial Sequence
  CD80 v7 IgV
VIHVTKEVKEVATLSCGHNVSVEELAQTRIYWQKEKKMVLTMMPGDMNIWPEYKNRTIFDITNNLSIVIQALRPSDEGTYECVVLKYEKDGFKREHLAEVT

SEQ ID NO: 3303 - protein, 101 aa, Artificial Sequence; identical to SEQ ID NO: 3300
  CD80 v9 IgV

SEQ ID NO: 3304 - protein, 101 aa, Artificial Sequence
  CD80 v10 IgV
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVT

SEQ ID NO: 3305 - protein, 101 aa, Artificial Sequence
  CD80 v11 IgV
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVT

SEQ ID NO: 3306 - protein, 101 aa, Artificial Sequence
  CD80 v12 IgV
VIHVTKEVKEVATLSCGHNVSVEELAQTRIYWQKEKKMVLTMMSGDMNIWPEYKNRTIFDITNNLSIVIQALRPSDEGTYECVVLKNEKDGFKREHLAEVT

SEQ ID NO: 3307 - protein, 101 aa, Artificial Sequence
  CD80 v13 IgV
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVT

SEQ ID NO: 3308 - protein, 101 aa, Artificial Sequence
  CD80 v14 IgV
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVT

SEQ ID NO: 3309 - protein, 101 aa, Artificial Sequence
  CD80 v15 IgV
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVT

SEQ ID NO: 3310 - protein, 101 aa, Artificial Sequence
  CD80 v16 IgV
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVT

SEQ ID NO: 3311 - protein, 101 aa, Artificial Sequence
  CD80 v17 IgV
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVT

SEQ ID NO: 3312 - protein, 101 aa, Artificial Sequence
  CD80 v19 IgV
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVT

SEQ ID NO: 3313 - protein, 101 aa, Artificial Sequence
  CD80 v21 IgV
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVT

SEQ ID NO: 3314 - protein, 101 aa, Artificial Sequence
  CD80 v22 IgV
VIHVTKEVKEVATLSCGHNVSVEELAQTRIYWQKEKKMVLTMMSGDMNIWPEYMNRTIFDITNNLSIVILALRPSDEGTYECVVLKYEKDGFKREHLAEVT

SEQ ID NO: 3315 - protein, 101 aa, Artificial Sequence
  CD80 v23 IgV
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVT

SEQ ID NO: 3316 - protein, 101 aa, Artificial Sequence
  CD80 v24 IgV
VIHVTKEVKEVATLSCGHNVSVEELAQTHIYWQKEKKMVLTMMSGDMNIWPGYKNRTIFDITNNLSIVIRALRPSDEGTYECVVLKYGKDGFKREHLAEVT

SEQ ID NO: 3317 - protein, 101 aa, Artificial Sequence
  CD80 v25 IgV
VIHVTKEVKEVATLSCGHNVSVEELAQTRIHWQKEKKMVLGMMSGDMNIWPEYKNRTIFDITNNLSIVIQALRPSDEGTYECVVLKYEKDGFKREHLAEVT

SEQ ID NO: 3318 - protein, 101 aa, Artificial Sequence
  CD80 v26 IgV
VIHVTKEVKEVATLSCGHNVSVEELAQTRIYWQKEKKMVLTMMSGDMNIWPEYKNRTIFDITNNLSIAILALRPSDEGTYECVVLKYEKDAFKREHLAEVT

SEQ ID NO: 3319 - protein, 101 aa, Artificial Sequence
  CD80 v27 IgV
VIHVTKEVKEVATLSCGHNVSVEELAQTRIYWQKEKKMVLTMMSGDMNIWPEYKNRTIFDITNNLHIVILALRPSDEGTYECVVLKYEKGAFKREHLAEVT

SEQ ID NO: 3320 - protein, 101 aa, Artificial Sequence
  CD80 v28 IgV
VIHVTKEVKEVATLSCGHNVSVEELAQTHIYWQKEKKMVLTMMSGDMNIWPGYKNRTIFDITNNLSIVILALRPSDEGTYECVVLKYEKDAFKREHLAEVT

SEQ ID NO: 3321 - protein, 101 aa, Artificial Sequence
  CD80 v30 IgV
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVT

SEQ ID NO: 3322 - protein, 101 aa, Artificial Sequence
  CD80 v32 IgV
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVT

SEQ ID NO: 3323 - protein, 101 aa, Artificial Sequence
  CD80 v33 IgV
VIHVTKEVKEVATLSCGHNVSAEELAQTRIYWQKEKKMVLTMMSGDMNIWPEYKNRTIFDITNNLSIVIQALRPSDEGTYECVVLKYEKDAFKREHLAEVT

SEQ ID NO: 3324 - protein, 101 aa, Artificial Sequence
  CD80 v34 IgV
VIHVTKEVKEVVTLFCGHNVSVEELAQTRIHWQKEKKMVLGMMSGDMNIWPEYKNRTIFDITNNLSIVILALRPSDEGTYECVVLKYEKDAFKREHLAEVT

SEQ ID NO: 3325 - protein, 101 aa, Artificial Sequence
  CD80 v35 IgV
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVT

SEQ ID NO: 3326 - protein, 101 aa, Artificial Sequence
  CD80 v36 IgV
VIHVTKEVKEVATLSCGHNVSVEGPAQTRIYWQKEKKMVLTMMSGDMNIWPEYKNRTIFDITNNLSIVIQALRPSDEGTYECVVLKYEKDAFKREHLAEVT

SEQ ID NO: 3327 - protein, 101 aa, Artificial Sequence
  CD80 v37 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVT

SEQ ID NO: 3328 - protein, 101 aa, Artificial Sequence
  CD80 v38 IgV
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVT

SEQ ID NO: 3329 - protein, 101 aa, Artificial Sequence
  CD80 v40 IgV
VIHVTKEVKEVATLSCGHNVSVEELAQTDILWHKEGKIVLATRSGDTNIWPEYKNRTIFDITNNLSIVILALRPSDEGTYVCVVRKYENDTPVLEHLAEVT

SEQ ID NO: 3330 - protein, 101 aa, Artificial Sequence
  CD80 v41 IgV
VIHVTKEVKEVATLSCGHNVSVEGLAQTDILWHKEGKIVLAMRSGDTNIWPEYKNRTILDITNNLSIVILALRPSDEGTYVCVVRKYENDTPVLERLAEVT

SEQ ID NO: 3331 - protein, 101 aa, Artificial Sequence
  CD80 v43 IgV
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVT

SEQ ID NO: 3332 - protein, 101 aa, Artificial Sequence
  CD80 v44 IgV
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVT

SEQ ID NO: 3333 - protein, 101 aa, Artificial Sequence
  CD80 v45 IgV
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVT

SEQ ID NO: 3334 - protein, 101 aa, Artificial Sequence
  CD80 v47 IgV
VIHVTKEVKEVATLSCGHNVSVEELAQTRIYWQKEGQIVLTMMSGDMNIWPEYKNRTILDITNNLSIVILALRPSDEGTYVCVVRKYENDTPVLEHLAGVT

SEQ ID NO: 3335 - protein, 101 aa, Artificial Sequence
  CD80 v48 IgV
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVT

SEQ ID NO: 3336 - protein, 101 aa, Artificial Sequence
  CD80 v49 IgV
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVT

SEQ ID NO: 3337 - protein, 101 aa, Artificial Sequence
  CD80 v50 IgV
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVT

SEQ ID NO: 3338 - protein, 101 aa, Artificial Sequence
  CD80 v51 IgV
VIHVTKEVKEVATLSCGHNVSVEELAQTHIHWQKEKKMVLGMMSGDMNIWPEYKNRTIFDITNNLSIVILALRPSDEGTYECVVLKNGENGFKREHLAEVT

SEQ ID NO: 3339 - protein, 101 aa, Artificial Sequence
  CD80 v52 IgV
VIHVTKEVKEVTTLSCGLNVSVEELAQTRIYWQKEKKMVLTMVSGDMNIWPEYKNRTILDITNNLSIVILALRPSDKGTYECVVLKYEKDAFKREHLAEVT

SEQ ID NO: 3340 - protein, 101 aa, Artificial Sequence
  CD80 v53 IgV
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVT

SEQ ID NO: 3341 - protein, 101 aa, Artificial Sequence
  CD80 v54 IgV
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVT

SEQ ID NO: 3342 - protein, 208 aa, Artificial Sequence
  CD80 v55 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3343 - protein, 208 aa, Artificial Sequence
  CD80 v56 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 3344 - protein, 208 aa, Artificial Sequence
  CD80 v57 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3345 - protein, 208 aa, Artificial Sequence
  CD80 v58 ECD
VIHVTKEVKEVATLSCGHNVSVEELAQTDILWHKEGKIVLAMRSGDTNIWPEYKNRTIFDITNNLSIVILALRPSDEGTYVCRVLKYENDTPVLEHLAEVTLSVKADFPTPSISDFEIPSSNIRRIICSASGGFPEPHLSWLENGEELNAINTTVSQDPETELYAVSSKLDFNTTTNHSFMCLIKYGHLRVNQTFNWNTTKQEHFPDN

SEQ ID NO: 3346 - protein, 208 aa, Artificial Sequence
  CD80 v59 ECD
VIHVTKEVKEVATLSCGHNVSVEELAQTDILWHKEGKIVLAMRSGDTNIWPEYKNRTILDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3347 - protein, 208 aa, Artificial Sequence
  CD80 v60 ECD
VIHVTKEVKEVATLSCGRNVSVEELAQTDILWHKEGEIVLAMRSGDTNIWPEYKNRTIFDITNNLSIVIQALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 3348 - protein, 208 aa, Artificial Sequence
  CD80 v61 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRITCSASGGFPEPHLSWLGNGEELNAINTTVSQDPETELYAVSSELDFNVTTNHSFMCLIKYGDLRVNQTFNWNTTKQEHFPDN

SEQ ID NO: 3349 - protein, 208 aa, Artificial Sequence; identical to SEQ ID NO: 3343
  CD80 v62 ECD

SEQ ID NO: 3350 - protein, 208 aa, Artificial Sequence
  CD80 v63 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3351 - protein, 208 aa, Artificial Sequence
  CD80 v64 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3352 - protein, 208 aa, Artificial Sequence; identical to SEQ ID NO: 3343
  CD80 v65 ECD

SEQ ID NO: 3353 - protein, 208 aa, Artificial Sequence
  CD80 v66ECD
VIHVTKEVKEVATLSCGHNVSVEELAQTDILWHKEGKIVLAMRSGDTNIWPEYKNRTIFDITNNLSIVILALRPSDEGTYECVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGDLRVNQTFNWNTTKQEHFPDN

SEQ ID NO: 3354 - protein, 208 aa, Artificial Sequence
  CD80 v67 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADLPTPSISDFEIPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 3355 - protein, 208 aa, Artificial Sequence
  CD80 v68 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGDLRVNQTFNWNTTKQEHFPDN

SEQ ID NO: 3356 - protein, 208 aa, Artificial Sequence; identical to SEQ ID NO: 3351
  CD80 v69 ECD

SEQ ID NO: 3357 - protein, 208 aa, Artificial Sequence
  CD80 v70 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 3358 - protein, 208 aa, Artificial Sequence
  CD80 v71 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITYSASGGFPEPHLSWLENGEELNAINTTVSQDPETELYAVSSKLDFNMTTNHSFMCLIKYGDLRVNQTFNWNTTKQEHFPDN

SEQ ID NO: 3359 - protein, 208 aa, Artificial Sequence
  CD80 v72 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFEIPTSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3360 - protein, 208 aa, Artificial Sequence
  CD80 v73 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3361 - protein, 208 aa, Artificial Sequence
  CD80 v74 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3362 - protein, 208 aa, Artificial Sequence
  CD80 v75 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPILEHRAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3363 - protein, 208 aa, Artificial Sequence
  CD80 v76 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPILEHRAEVTLSVKADFPTPSISDFEIPTSNIRRIICSASGGFPEPHLSWLENGEESNAINTTVSQDPETELYAVSSKLDFNMTTNHSFMCLIKYGHLRVNQTFNWNTTKQEHFPDN

SEQ ID NO: 3364 - protein, 208 aa, Artificial Sequence
  CD80 v77 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3365 - protein, 208 aa, Artificial Sequence
  CD80 v78 ECD
VIHVTKEVKEVATLSCGHNVSVEELAQTDILWHKEGKIVLAMRSGDTNIWPEYKNRTIFDNTNNLSIVILALRPSDEGTYVCVVRKYENDTPVFEHLAEVTLSAKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3366 - protein, 208 aa, Artificial Sequence
  CD80 v79 ECD
VIHVTKEVKEVATLSCGHNVSVEELAQTDILWHKEGKIVLAMRSGDTNIWPEYKNRTIFDITNNLSIVILALRPSDEGTYVCVVRKYENDAPVFEHLAEVTLSVKADFPTPSISDFEVPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3367 - protein, 208 aa, Artificial Sequence
  CD80 v80 ECD
VIHVTKEVKEVATLSCGHNVSVEELAQTDILWHKEGKIVLAMRSGDTNIWPEYKNRTIFDISNNLSIVILALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMATNHSFMCLIKYGHLRVNQTFNWNTTKQEHFPDN

SEQ ID NO: 3368 - protein, 208 aa, Artificial Sequence
  CD80 v81 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDSEIPTSNIRRIICSASGGFPEPHLSWLENGEELNAINTTVSQDPETELYAVSSKLDFNMTTNHSFMCLIKYGDLRVNQTFNWNTTKQEHFPDN

SEQ ID NO: 3369 - protein, 208 aa, Artificial Sequence
  CD80 v82 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPSSNIRRITCSASGGFPEPHLSWSENGEELNAINTTVSQDPETELYAVSSKLDFNMTTNHSFMCLIKYGDLRVNQTFNWNTTKQEHFPDN

SEQ ID NO: 3370 - protein, 208 aa, Artificial Sequence
  CD80 v83 ECD
VIHVTKEVKEVATLSSGLNVSVEELAQTDILWHKEGKIVLAMRSGDTNIWPEYKNRTIFDITNNLSIVILALRPSDEGTYVCVVRKYENDTPVLEHLAEVTLSVKADFPAPSISDFEIPTSNIRRIICSTSGGFPEPHLSWLENGEELNAINTTVSQDPETELYAVSSKLDFNMTTNHSFMCLIKYGDLRVNQTFNWNTTKQEHFPDN

SEQ ID NO: 3371 - protein, 208 aa, Artificial Sequence
  CD80 v84 ECD
VIHVTKEVKEVATLSCGHNVSVEELAQTDILWHKEGKIVLAMRSGDTNIWPEYKNRTIFDITNNLSIVILALRPSDEGTYECVVLKYEKDGFKREHLAEVTLSVKADFPTPSISDFEIPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3372 - protein, 208 aa, Artificial Sequence
  CD80 v85 ECD
VIHVTKEVKEVATLSCGHNVSVEELAQTDILWHKEGKIVLAMRSGDTNIWPEYKNRTIFDITNNLSIVIQALRPSGEGTYECVVLKYEKDGFKREHLAEVTLLVKADFPTPSISDFEIPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 3373 - protein, 207 aa, Artificial Sequence
  CD80 v86 ECD
VIHVTKEVKEVATLSCGHNVSVEELAQTRIYWKEKKMVLTMMSGDMNIWPECKNRTIFDITNNLSIVILALRPSDEGTYECVVRKYENDTPVLEHLAEVTLSVKADFPTPSISDFEIPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3374 - protein, 208 aa, Artificial Sequence
  CD80 v87 ECD
VIHVTKEVKEVATLSCGHNVSVEELAQTRIYWQKEKKMVLTMMSGDMNIWPEYKNRTIFDISNNLSIVILALRPSDEGTYVCVVRKYENDTPVLEHLAEVTLSVKADFPTPSISDFEIPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3375 - protein, 208 aa, Artificial Sequence
  CD80 v88 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICLTSGGFPEPHLSWLENGEELNAINTTVSQDPETELYAVSSKLDFNMTTNHSFMCLIKYGDLRVNQTFNWNTTKQEHFPDN

SEQ ID NO: 3376 - protein, 208 aa, Artificial Sequence
  CD80 v89 ECD
VIHVTKEVERSGNAVLWYNVSVEELAQTRIYWQKEKKMVLTMMSGDMNIWPECKNRTIFDITNNLSIVIQALRPSDEGTYECVVLKYEKGAFKREHLAEVTLSVKADFPTPSISDFEIPTSNIRRIICSASGGFPEPHLSWLENGEELDAITTTVSQDPETELYAVSSKLDFNMTTNHSFMCLIKYGDLRVNQTFNWNTTKQEHFPDN

SEQ ID NO: 3377 - protein, 208 aa, Artificial Sequence
  CD80 v90 ECD
VIHVTKEVKEVATLSCGLNVSVEELAQTDILWHKEGKMVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3378 - protein, 208 aa, Artificial Sequence
  CD80 v91 ECD
VIHVTKEVKEVATLSCGHNVSVEELAQTRIYWQKEKKMVLTMMSGDMNIWPEYKNRTIFDITNNLSIVILALRPSDEGTYECVVLKYEEDAFEREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3379 - protein, 208 aa, Artificial Sequence
  CD80 v92 ECD
VIHVTKEVKEVATLSCGHNVPVEELAQTDILWHKEGKIVLAMRSGDTIIWPEYKNRTIFDITNNLSIAILALRPSDEGTYVCVVRKYENDTPVLEHLAEVTLSVKADFHTPSISDFEIPTSNIRRLICSTSGGFPEPHLSWLENGEELNAINTTVSQDPETELYAVSSILDFNMTTNHSFMCLIKYGHLRVNQTFNWNTTKQEHFPDN

SEQ ID NO: 3380 - protein, 208 aa, Artificial Sequence
  CD80 v93 ECD
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHRAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3381 - protein, 208 aa, Artificial Sequence
  CD80 v94 ECD
VIHVTKEVKEVATLSCGHNVPVEELAQTDILWHKEGKIVLAMRSGDTNIWPEYKNRTIFDITNNLSIVILALRLSDEGTNVCVVRKYENNTPVLEHLAEVTLSVKADFPTPSISDFEIPTSNIRRIICSASGGFPEPHLSWLENGEELSAINTTVSQDPETGLYAVSSKLDFNMTTNHSFMCLIKYGHLRVNQTFNWNTTKQEHFPDN

SEQ ID NO: 3382 - protein, 208 aa, Artificial Sequence
  CD80 v95 ECD
VIHVTKEVKEVATLSCGLNVSVEELAQTDILWHKEGKIVLAMRSGDTNIWPEYKNRTIFDITNNLSIMILALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3383 - protein, 208 aa, Artificial Sequence
  CD80 v96 ECD
VIHVTKEVKEVATLSCGHNVSVEELAQTDILWHKEGKIVLAMRSGDTNIWPEYKNRTIFDITNNLSIMILALRPSDEGTYVCVVRKYENDTPVLEHLAEVTLSVKADFPTPSISDFEIPTSNIRRIICSASGGFPEPHLSWLENGEELSAINTTVSQDPETELYAVSSKLDFNMTTNHSFMCLIKYGHLSVNQTFNWNTTKQEHFPDN

SEQ ID NO: 3384 - protein, 208 aa, Artificial Sequence
  CD80 v97 ECD
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLSVNQTFNWNTTKQEHFPDN

SEQ ID NO: 3385 - protein, 208 aa, Artificial Sequence
  CD80 v98 ECD
VIHVTKEVKEVATLSGGHNVSAEELAQTDILWHKEGKIVLAMRSGDTNIWPEYKNRTIFDITNNLSIMILALRPSGEGTYVCVVRKYENDTPVLEHLAEVTLSVKADFPTPSISDFETPTSNIRRIICSASGGFPEPHLTWLENGEELSAINTTVSQDPETELYAVSSILDFNMTTNRSFMCLIKYGHLRVDQTFNWNTTKQEHFPDN

SEQ ID NO: 3386 - protein, 208 aa, Artificial Sequence
  CD80 v99 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFVTPTSNIRRIICSTSGGFPEPHLSWLENGEELSAINTTVSQDPETELYAVSGKLDFNMTTNHSFMCLIKYGQLRVNQTFNWNTTKQEHFPDN

SEQ ID NO: 3387 - protein, 208 aa, Artificial Sequence
  CD80 v100 ECD
VIHVTKEVKEVATLSCGHNVSAEELAQTDILWHKEGKIVLAMRSGDTNIWPEYKNRTIFDITNNLSIMILALRPSDEGTYVCVVRKYENDTPVLEHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3388 - protein, 208 aa, Artificial Sequence
  CD80 v101 ECD
VIHVTKEVKEVATLSCGHNVSVEELAQTDILWHKEGKIVLAMRSGDTNIWPEYKNRTIFDITNSLSIVILALRPSDEGTYVCVVRKYENDTPVFEHLAEVTLSVKADFPTPSISDFETPTSNIRRIICSASGGFPEPHLSWLENGEELSAINTTVSQDPETELYAVSSILDFNMTTNHSFMCLIKYGHLRVNQTFNWNTTKQEHFPDN

SEQ ID NO: 3389 - protein, 208 aa, Artificial Sequence
  CD80 v102 ECD
VIHVTKEVKEVATLSCGHNVSAEELAQTDILWHKEGKIVLAMRSGDTNIWPEYKNRTIFDITNNLSIMILALRPSDEGTYVCVVRKYENDTPVLEHLAEVTLSVKADFPTPSISGFETPTSNIRRIICSASGDFPEPHLSWLENGEELSAINTTVSQDPETELYAVSSKLDFNMTTNHSFMCLIKYGHLRVNQTFNWNTTKQEHFPDN

SEQ ID NO: 3390 - protein, 208 aa, Artificial Sequence
  CD80 v103 ECD
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTTVSQDPETELYAVSSKLDFNMTTNHSFMCLIKYGHLRVNQTFNWNTTKQEHFPDN

SEQ ID NO: 3391 - protein, 208 aa, Artificial Sequence
  CD80 v104 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPTSNIRRIICPTSGGFPEPHLSWLENGEELNAINTTVSQDPETELYAVSSKLDFNMTTNHSFMCLIKYGHLRVNQTFNWNTTKQEHFPDN

SEQ ID NO: 3392 - protein, 208 aa, Artificial Sequence
  CD80 v105 ECD
VIHVTKEVKEVATLSCGHNVSVEELAQTRIYWQKEKKMVLTMMSGDMNIWPEYKNRTIFDITNNLSIVTQALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3393 - protein, 208 aa, Artificial Sequence
  CD80 v106 ECD
VIHVTKEVKEVATLSCGHNVSVEELAQTRIHWQKEKKMVLTMMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTTVSQDPETELYAVSSKLDFNMTTNHSFMCLIKYGHLRVNQTFNWNTTKQEHFPDN

SEQ ID NO: 3394 - protein, 208 aa, Artificial Sequence
  CD80 v107 ECD
VIHVTKEVKEVATLSCGHNVSVEELAQADILWHKEGKIVLAMRSGDTNIWPEYKNRTIFDITNNLSIVILALRPSDEGTYVCVVRKYENDTPVLEHLAEVTLSLKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 3395 - protein, 208 aa, Artificial Sequence
  CD80 v108 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHRAEVTLSVKADFPTPSISDFEIPTSNIRRIICSTSGGFPEPHLSWLENGEELSAINTTVSQDPETELYAVSSKLDFNMTTNHSFMCLIKYGQLRVNQTFNWNTTKQEHFPDN

SEQ ID NO: 3396 - protein, 208 aa, Artificial Sequence
  CD80 v109 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHRAEVTLSVKADFPTPSISDFEIPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 3397 - protein, 208 aa, Artificial Sequence
  CD80 v110 ECD
VIHVTKEVKEVATLSCGLNVSVEELAQTDILWHKEGKIVLAMRSGDTNIWPEYKNRTIFDITNNLSIAILALRPSDEGTYVCVVRKYENDTPVLEHLAEVTLSVKADFPTPSISDFEIPTSNIRRIICSASGGFPEPHLSWLENGEELSAINTIVSQDPETELYAVSSKLDFNMTTNHSFMCLIKYGHLRVNQTFNWNTTKQEHFPDN

SEQ ID NO: 3398 - protein, 208 aa, Artificial Sequence
  CD80 v111 ECD
VIHVTKEVKEVGTLSCGHNVSVEELAQTDILWHKEGKIVLAMRSGDTNIWPEYKNRTIFDITNNLSIAILALRPSDEGTYVCVVRKYENDTPVLEHRAEVTLSVKADFPTPSISDFEIPTSNIRRIICSASGGFPEPHLSWLENGEELNAINTTVSQDPETELYAVSSKLDFNMTTNHSFMCHIKYGHLRVNQTFNWNTTKQEHFPDN

SEQ ID NO: 3399 - protein, 208 aa, Artificial Sequence
  CD80 v112 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLTWLENGEELSAINTTVSQDPETELYAVSSSLDFNMTTNHSFMCLIKYGHLRVNQTFNWNTTKQEHFPDN

SEQ ID NO: 3400 - protein, 208 aa, Artificial Sequence
  CD80 v113 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSILDFNMTTNHSFMCLIKYGHLRVNLTFNWNTTKQEHFPDN

SEQ ID NO: 3401 - protein, 208 aa, Artificial Sequence
  CD80 v114 ECD
VIHVTKEVKEVATLSCGHNVSAEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 3402 - protein, 208 aa, Artificial Sequence
  CD80 v115 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 3403 - protein, 208 aa, Artificial Sequence
  CD80 v116 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSASGGFPEPHLSWLENGEELSAINTTVSQDPETELYAVSSILDFNMTTNHSFMCLIKYGHLRVNQTFNWNTTKQEHFPDN

SEQ ID NO: 3404 - protein, 208 aa, Artificial Sequence
  CD80 v117 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFEIPTSNIRRIICSASGGFPEPHLSWLENGEELSAINTTVSQDPETELYAVSSILDFNMTTNHSFMCLIKYGHLRVNQTFNWNTTKQEHFPDN

SEQ ID NO: 3405 - protein, 208 aa, Artificial Sequence
  CD80 v118 ECD
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFETPTSNIRRIIRSTSGGFPEPHLSWLENGEELNAINTTVSQDPETELYAVSSKLDFNMTTNHSFMCLIKYGHLRVNQTFNWNTTKQEHFPDN

SEQ ID NO: 3406 - protein, 208 aa, Artificial Sequence
  CD80 v119 ECD
VIHVTKEVKEVATLSCGHNVSVEELARTCIYWQKEKKMVLTTMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTTVSQDPGTELYAVSSKLDFNMTTNHSFMCLIKYGHLRVNQTFNWNTTKQEHFPDN

SEQ ID NO: 3407 - protein, 208 aa, Artificial Sequence
  CD80 v120 ECD
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICPTSGGFPEPHLSWLENGEELNAINTAVSQDPETELYAVSSKLDFNMTTNHSFMCLIKYGHLRVNQTFNWNTTKQEHFPDN

SEQ ID NO: 3408 - protein, 208 aa, Artificial Sequence
  CD80 v121 ECD
VIHVTKEVKEVATLSCGHNVPVEELAQTRIYWQKEKKMVLTMMSGDMNIWPEYKNRTIFDITNNLSIVIQALRPSDEGTYECVVLKYEKGAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3409 - protein, 101 aa, Artificial Sequence
  CD80 v93 IgV
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHRAEVT

SEQ ID NO: 3410 - protein, 208 aa, Artificial Sequence
  CD80 v122 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSTSGGFPEPHLSWLEDGEELNAINTTVSQDPETELYAVSSKLDFNMTTNHSFMCLIKYGHLRVNQTFNWNTTKQEHFPDN

SEQ ID NO: 3411 - protein, 208 aa, Artificial Sequence
  CD80 v123 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEAPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3412 - protein, 208 aa, Artificial Sequence
  CD80 v124 ECD
VIHMTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3413 - protein, 208 aa, Artificial Sequence
  CD80 v125 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3414 - protein, 208 aa, Artificial Sequence
  CD80 v126 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVSQTFNWNTTKQEHFPDN

SEQ ID NO: 3415 - protein, 208 aa, Artificial Sequence
  CD80 v127 ECD
VIHVTKEVKEVATLSCGHNLSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3416 - protein, 208 aa, Artificial Sequence
  CD80 v128 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFGVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3417 - protein, 208 aa, Artificial Sequence
  CD80 v129 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3418 - protein, 208 aa, Artificial Sequence
  CD80 v130 ECD
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNSTKQEHFPDN

SEQ ID NO: 3419 - protein, 208 aa, Artificial Sequence
  CD80 v131 ECD
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVTLSVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 3420 - protein, 208 aa, Artificial Sequence
  CD80 v132 ECD
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVTLSVKADFPTPSISDFEVPSSNIRRVICSASGGFPEPHLSWLENGEELNAINTTVSQDPETELYAVSNKLDFNMTTNHSFMCLIKYGHLRVNQTFNWNTTKQEHFPDN

SEQ ID NO: 3421 - protein, 208 aa, Artificial Sequence
  CD80 v133 ECD
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVTLSVKADFPTPSITDFEVPSSNIRRIICSASGGFPEPHLSWLENGEELNAINTTVSQDPETELYAVSSKLDFNMTTNHSFMCLIKYGDLRVNQTFNWNTTKQEHFPDN

SEQ ID NO: 3422 - protein, 208 aa, Artificial Sequence
  CD80 v134 ECD
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVTLSVKADFPTPSISDFEVPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 3423 - protein, 208 aa, Artificial Sequence
  CD80 v135 ECD
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVTLSVKANFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3424 - protein, 208 aa, Artificial Sequence
  CD80 v136 ECD
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIEYGHLRVNQTFNWNTTKQEHFPDN

SEQ ID NO: 3425 - protein, 208 aa, Artificial Sequence
  CD80 v137 ECD
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3426 - protein, 208 aa, Artificial Sequence
  CD80 v138 ECD
VIHVTKEVKEVATLSCGHNVSVEELAQTRIYWQKEKKMVLTMMSGDMNIWPEYMNRTIFDITNNLSIVIQALRPSDEGTYECVVLKYEKDGFKREHLAEVTLSVKADFPTPSISDFEIPTSNIRRIICSTSGGFPEPHLSWLENGEELNAINTTVSQDPETELHAVSSKLDFNMTTNHSFMCLIKYGDLRVNQTFNWNTTKQEHFPDN

SEQ ID NO: 3427 - protein, 208 aa, Artificial Sequence
  CD80 v139 ECD
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVTLSVKADFPTPSISDFEVPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 3428 - protein, 208 aa, Artificial Sequence
  CD80 v140 ECD
VIHVTKEVKEVATLSCGHNVSVEELAQTRIHWQKEKKMVLGMLSGDMNIWPEYKNRTIFDITNNLSIVIQALRPSDEGTYECVVLKYEKDGFKREHLAEVTLSVKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 3429 - protein, 208 aa, Artificial Sequence
  CD80 v141 ECD
VIHVTKEVKEVATLSCGHNVSVEELAQTRIYWQKEKKMVLTMMSGDMNIWPEYKNRTIFDITNNHSIVILALRPSDEGTYECVVLKYEKGAFKREHLAEVTLSVKADFPAPSISDLEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3430 - protein, 208 aa, Artificial Sequence
  CD80 v142 ECD
VIHVTKEVKEVATLSCGHNVSVEELAQTHIYWQKEKKMVLTMMSGDMNIWPGYKNRTIFDITNNLSIVILALRPSDEGTYECVVLKYEKNAFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3431 - protein, 208 aa, Artificial Sequence; identical to SEQ ID NO: 3430
  CD80 v143 ECD

SEQ ID NO: 3432 - protein, 208 aa, Artificial Sequence
  CD80 v144 ECD
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEVPSSNIRRIICSTSGGFPEPHLSWLENGEELNAINTTVSQDPETELYAVSSKLDFNMTTNHSFMCLIKYGHLRVNQTFHWNTTKQEHFPDN

SEQ ID NO: 3433 - protein, 208 aa, Artificial Sequence
  CD80 v145 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPAPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3434 - protein, 208 aa, Artificial Sequence
  CD80 v146 ECD
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVTLSVKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 3435 - protein, 208 aa, Artificial Sequence
  CD80 v147 ECD
VIHVTKEVKEVVTLFCGHNVSVEELAQTRIHWQKEKKLVLGMLSGDMNIWPEYKNRTIFDITNNLSIVILALRPSDEGTYECVVLKYEKNAFKREHLAEVTLSVKADFPTPSISDFEIPTSNIRRIICSASGGFPELHLSWLENGEELDAITTTVSQDPETELYAVSSKLDFNMTTNHSFMCLIKYGHLRVNQTFNWNTTKQEHFPDN

SEQ ID NO: 3436 - protein, 208 aa, Artificial Sequence
  CD80 v148 ECD
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3437 - protein, 208 aa, Artificial Sequence
  CD80 v149 ECD
VIHVTKEVKEVATLSCGHNVSVEGPAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSTSGGFPEPHLSWLENGEELNAITTTVSQDPETELYAVSSKLDFNMTTNHSFMCLIKYGHLRVNQTFNWNTTKQEHFPDN

SEQ ID NO: 3438 - protein, 208 aa, Artificial Sequence
  CD80 v150 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVTLSVKADLPTPSISDFEVPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3439 - protein, 208 aa, Artificial Sequence
  CD80 v151 ECD
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKADFPTPSISDFEIPTSSIRRIICSTSGGFPEPHLSWLENGEELNAINTTVSQDPETELYAVSSKLDFNMTTSHSFMCLIKYGHLRVNQTFNWNTTKQEHFPDN

SEQ ID NO: 3440 - protein, 208 aa, Artificial Sequence
  CD80 v152 ECD
VIHVTKEVKEVATLSCGHNVSVEELAQTRIYWQKEGQIVMTMMSGDMNIWPEYKNRTILDITNNLSIVILALRPSDEGTYVCVVRKYENDTPVLEHLAGVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 3441 - protein, 208 aa, Artificial Sequence
  CD80 v153 ECD
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 3442 - protein, 208 aa, Artificial Sequence
  CD80 v154 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3443 - protein, 208 aa, Artificial Sequence
  CD80 v155 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 3444 - protein, 208 aa, Artificial Sequence; identical to SEQ ID NO: 3364
  CD80 v156 ECD

SEQ ID NO: 3445 - protein, 208 aa, Artificial Sequence
  CD80 v157 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNTTTNHSFMCLIKYGHLRVNQTFNWNTTKQEHFPDN

SEQ ID NO: 3446 - protein, 208 aa, Artificial Sequence
  CD80 v158 ECD
VIHVTKEVKEVATLSCGHNVSVEELAQTDILWHKEGKIVLAMRSGDTDIWPEYKNRTILDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3447 - protein, 208 aa, Artificial Sequence
  CD80 v159 ECD
VIHVTKEVKEVATLSCGRNVSVEELAQTDILWHKEGEIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 3448 - protein, 208 aa, Artificial Sequence
  CD80 v160 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRITCSASGGFPEPHLSWLGNGEELNAINTTVSQDPETELYAVSSELDFNVTTNHSFMCLIKYGDLRVNQTFNWNTTKQEHFPDN

SEQ ID NO: 3449 - protein, 208 aa, Artificial Sequence
  CD80 v161 ECD
VIHVTKEVKEVATLSCGHNVSVEELAQTDVLWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3450 - protein, 208 aa, Artificial Sequence
  CD80 v162 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3451 - protein, 208 aa, Artificial Sequence
  CD80 v163 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3452 - protein, 208 aa, Artificial Sequence
  CD80 v164 ECD
VIHVTKEVKEVATLSCGHNVSVEELAQTDILWHKEGKIVLAMRSGDTNIWPEYKNRTIFDITNNLSIVIQALRPSDEGTYVCVVLKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 3453 - protein, 208 aa, Artificial Sequence
  CD80 v165 ECD
VIHVTKEVKEVATLSCGHNVSVEELAQTDILWHKEGKIVLAMRSGDTNIWPEYKNRTIFDITNNLSIVILALRPSDEGTYECVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGDLRVNQTFNWNTTKQEHFPDN

SEQ ID NO: 3454 - protein, 208 aa, Artificial Sequence
  CD80 v166 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADLPTPSISDFEVPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 3455 - protein, 208 aa, Artificial Sequence
  CD80 v167 ECD
VIHVTKEVKEVATLSCGHNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELDAINTTVSQDPETELYAVSSELDFNMTTNHSFMCLIKYGDLRVNQTFNWNTTKQEHFPDN

SEQ ID NO: 3456 - protein, 208 aa, Artificial Sequence
  CD80 v168 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGDLRVNQTFNWNTTKQEHFPDN

SEQ ID NO: 3457 - protein, 208 aa, Artificial Sequence
  CD80 v169 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITYSASGGFPEPHLSWLENGEELNAINTTVSQDPETELYAVSSKLDFNMTTNHSFMCLIKYGDLRVNQTFNWNTTKQEHFPDN

SEQ ID NO: 3458 - protein, 208 aa, Artificial Sequence
  CD80 v170 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLADVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3459 - protein, 208 aa, Artificial Sequence
  CD80 v171 ECD
VIHVTKEVKEVATLSCGLNVSVEELAQTDILWHKEGKIVLAMRSGDTNIWPEYKNRTIFDITNNLSIVIQALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3460 - protein, 208 aa, Artificial Sequence
  CD80 v172 ECD
VIHVTKEVKEVATLSCGHNVSVEELAQTDILWHKEGKIVLAMRSGDTNIWPEYKNRTIFDNTNNLSIVILALRPSDEGTYVCVVRKYENDTPVFEHLAEVTLSAKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 3461 - protein, 208 aa, Artificial Sequence
  CD80 v173 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVFEHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 3462 - protein, 208 aa, Artificial Sequence; identical to SEQ ID NO: 3367
  CD80 v174 ECD

SEQ ID NO: 3463 - protein, 208 aa, Artificial Sequence
  CD80 v175 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWSENGEELNAINTTVSQDPETELYAVSSKLDFNMTTNHSFMCLIKYGDLRVNQTFNWNTTKQEHFPDN

SEQ ID NO: 3464 - protein, 208 aa, Artificial Sequence
  CD80 v176 ECD
VIHVTKEVKEVATLSSGLNVSVEELAQTDILWHKEGKIVLAMRSGDTNIWPEYKNRTIFDITNNLSIVILALRPSDEGTYVCVVRKYENDTPVLEHLAEVTLSVKADFPAPSISDFEVPTSNIRRIICSTSGGFPEPHLSWLENGEELNAINTTVSQDPETELYAVSSKLDFNMTTNHSFMCLIKYGDLRVNQTFNWNTTKQEHFPDN

SEQ ID NO: 3465 - protein, 208 aa, Artificial Sequence
  CD80 v177 ECD
VIHVTKEVKEVATLSCGHNVSVEELAQTDILWHKEGKIVLAMRSGDTNIWPEYKNRTIFDITNNLSIVILALRPSDEGTYECVVLKYEKDGFKREHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3466 - protein, 208 aa, Artificial Sequence
  CD80 v178 ECD
VIHVTKEVKEVATLSCGHNVSVEELAQTDILWHKEGKIVLAMRSGDTNIWPEYKNRTIFDITNNLSIVIQALRPSGEGTYECVVLKYEKDGFKREHLAEVTLLVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 3467 - protein, 208 aa, Artificial Sequence
  CD80 v179 ECD
VIHVTKEVKEVATLSCGHNVSVEELAQTRIYWQKEKKMVLTMMSGDMNIWPECKNRTIFDITNNLSIVILALRPSDEGTYECVVRKYENDTPVLEHLAEVTLSVKADFPTPSISDFEVPSSNIRRITCSASGGFPEPHLSWLENGEELNAINTTVSQDPETELYAVSSELDFNMTTNHSFMCLIKYGHLRVNQTFNWNTTKQEHFPDN

SEQ ID NO: 3468 - protein, 208 aa, Artificial Sequence
  CD80 v180 ECD
VIHVTKEVKEVATLSCGHNVSVEELAQTRIYWQKEKKMVLTMMSGDMNIWPEYKNRTIFDISNNLSIVILALRPSDEGTYVCVVRKYENDTPVLEHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 3469 - protein, 208 aa, Artificial Sequence
  CD80 v181 ECD
VIHVTKEVKEVATLSCGHNVSVEELAQTRIYWQKEKKMVLTMMSGDMNIWPECKNRTIFDITNNLSIVIQALRPSDEGTYECVVLKYEKGAFKREHLAEVTLSVKADFPTPSISDFEIPTSNIRRIICSASGGFPEPHLSWLENGEELDAITTTVSQDPETELYAVSSKLDFNMTTNHSFMCLIKYGDLRVNQTFNWNTTKQEHFPDN

SEQ ID NO: 3470 - protein, 208 aa, Artificial Sequence
  CD80 v182 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEVPSSNIRRITCSASGGFPEPHLSWLENGEELNAINTTVSQDPETELYAVSSKLDFNMTTNHSFMCLIKYGDLRVNQTFNWNTTKQEHFPDN

SEQ ID NO: 3471 - protein, 208 aa, Artificial Sequence
  CD80 v183 ECD
VIHVTKEVKEVATLSCGLNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 3472 - protein, 101 aa, Artificial Sequence
  CD80 v153 IgV
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVT

SEQ ID NO: 3473 - protein, 107 aa, Artificial Sequence
  CD80 v153 IgV
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVTLSVKAD

SEQ ID NO: 3474 - protein, 18 aa, Artificial Sequence
  CD80 trailing sequence
LSVKADFPTPSISDFEIP

SEQ ID NO: 3475 - protein, 107 aa, Homo sapiens; identical to SEQ ID NO: 1079
  MISC_FEATURE: CD80 IgV wildtype

SEQ ID NO: 3476 - protein, 107 aa, Artificial Sequence
  CD80 v46 IgV
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKAD

SEQ ID NO: 3477 - protein, 107 aa, Artificial Sequence; identical to SEQ ID NO: 1079
  CD80 v1 IgV

SEQ ID NO: 3478 - protein, 107 aa, Artificial Sequence
  CD80 v20 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKAD

SEQ ID NO: 3479 - protein, 107 aa, Artificial Sequence
  CD80 v43 IgV
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVTLSVKAD

SEQ ID NO: 3480 - protein, 107 aa, Artificial Sequence
  CD80 v44 IgV
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVTLSVKAD

SEQ ID NO: 3481 - protein, 107 aa, Artificial Sequence
  CD80 v18 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLPVKAD

SEQ ID NO: 3482 - protein, 107 aa, Artificial Sequence
  CD80 v48 IgV
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKAD

SEQ ID NO: 3483 - protein, 107 aa, Artificial Sequence
  CD80 v49 IgV
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVTLSVKAD

SEQ ID NO: 3484 - protein, 107 aa, Artificial Sequence
  CD80 v50 IgV
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVTLSVKAD

SEQ ID NO: 3485 - protein, 107 aa, Artificial Sequence
  CD80 v53 IgV
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVTLSVKAD

SEQ ID NO: 3486 - protein, 107 aa, Artificial Sequence
  CD80 v54 IgV
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVTLSVKAD

SEQ ID NO: 3487 - protein, 107 aa, Artificial Sequence
  CD80 v93 IgV
VIHVTKEVKEVATLSCGLNVSVEELAQTDILWHKEGKIVLAMRSGDTNIWPEYKNRTIFDITNNLSIVILALRLSDEGTNVCVVRKYENDTPVLEHRAEVTLSVKAD

SEQ ID NO: 3488 - protein, 107 aa, Artificial Sequence
  CD80 v19 IgV
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVTLSVKAD

SEQ ID NO: 3489 - protein, 107 aa, Artificial Sequence
  CD80 v29 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTSSVKAD

SEQ ID NO: 3490 - protein, 100 aa, Homo sapiens
  MISC_FEATURE: CD4 IgV
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGL

SEQ ID NO: 3491 - protein, 114 aa, Homo sapiens
  MISC_FEATURE: CD8A IgV
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPA

SEQ ID NO: 3492 - protein, 131 aa, Homo sapiens
  MISC_FEATURE: LAG3 IgV
GAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLG

SEQ ID NO: 3493 - protein, 243 aa, Homo sapiens
  MISC_FEATURE: CD48
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 3494 - protein, 194 aa, Homo sapiens
  MISC_FEATURE: CD48 ECD
QGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARS

SEQ ID NO: 3495 - protein, 127 aa, Artificial Sequence
  CTLA-4 wt ECD
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPSPDSDQ

SEQ ID NO: 3496 - protein, 266 aa, Artificial sequence; identical to SEQ ID NO: 2603
  PD-L1 303 - ICOSL 2264

SEQ ID NO: 3497 - protein, 266 aa, Artificial sequence; identical to SEQ ID NO: 2599
  PD-L1 303 - ICOSL 2266

SEQ ID NO: 3498 - protein, 253 aa, Artificial sequence; identical to SEQ ID NO: 2583
  PD-L2 1417 -ICOSL 2266

SEQ ID NO: 3499 - protein, 253 aa, Artificial sequence; identical to SEQ ID NO: 2587
  PD-L2 1417 - ICOSL 2264:

SEQ ID NO: 3500 - protein, 533 aa, Artificial sequence
  PD-L1 303 -PD-L1 303 - ICOSL 2264 -ICOSL 2264
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVDYKDDDDKHHHHHH

SEQ ID NO: 3501 - protein, 396 aa, Artificial sequence
  PD-L1 303 - ICOSL 2264  - PD-L1 303
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 3502 - protein, 533 aa, Artificial sequence
  PD-L1 303  - ICOSL 2264 - ICOSL 2264  - PD-L1 303
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 3503 - protein, 45 aa, Artificial sequence
  Moiety: COMP
DLGPQMLRELQETNAALQDVRELLRQQVREITFLKNTVMECDACG

SEQ ID NO: 3504 - protein, 33 aa, Artificial sequence
  Moiety: VASP
DLQRVKQELLEEVKKELQKVKEEIIEAFVQELR

SEQ ID NO: 3505 - protein, 40 aa, Artificial sequence
  Moiety: ZZ12.6
DVQAISSTIQDLQDQVDSLAEVVLQNRRGLDLLTRSGGGS

SEQ ID NO: 3506 - protein, 189 aa, Artificial sequence
  PD-L1 303 - COMP
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDLGPQMLRELQETNAALQDVRELLRQQVREITFLKNTVMECDACGDYKDDDDKHHHHHH

SEQ ID NO: 3507 - protein, 326 aa, Artificial sequence
  PD-L1 303 - ICOSL 2264 - COMP
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSDLGPQMLRELQETNAALQDVRELLRQQVREITFLKNTVMECDACGDYKDDDDKHHHHHH

SEQ ID NO: 3508 - protein, 177 aa, Artificial sequence
  PD-L1 303 - VASP
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDLQRVKQELLEEVKKELQKVKEEIIEAFVQELRDYKDDDDKHHHHHH

SEQ ID NO: 3509 - protein, 314 aa, Artificial sequence
  PD-L1 303 - ICOSL 2264 - VASP
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSDLQRVKQELLEEVKKELQKVKEEIIEAFVQELRDYKDDDDKHHHHHH

SEQ ID NO: 3510 - protein, 175 aa, Artificial sequence
  ZZ12.6 - PD-L1 303
DYKDDDDKHHHHHHGGGGSSDVQAISSTIQDLQDQVDSLAEVVLQNRRGLDLLTRSGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 3511 - protein, 184 aa, Artificial sequence
  PD-L1 303 - ZZ12.6
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDVQAISSTIQDLQDQVDSLAEVVLQNRRGLDLLTRSGGGSDYKDDDDKHHHHHH

SEQ ID NO: 3512 - protein, 354 aa, Artificial sequence; identical to SEQ ID NO: 2528
  PD-L2 1417  - Fc

SEQ ID NO: 3513 - protein, 497 aa, Artificial sequence
  PD-L1 303  - ICOSL 2266 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3514 - protein, 243 aa, Artificial sequence
  Hole Fc
HMSSVSAQAAAEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLYSKLTVDKSRWQQGNVFSCSVMHEALHNHYTQKSLSLSPGK

SEQ ID NO: 3515 - protein, 497 aa, Artificial sequence
  PD-L1 303  - ICOSL 2264 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3516 - protein, 495 aa, Artificial sequence
  PD-L1 303 - ICOSL 2266 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSDTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3517 - protein, 495 aa, Artificial sequence
  PD-L1 303 - ICOSL 2264 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3518 - protein, 500 aa, Artificial sequence
  PD-L1 303 - CTLA-4 3495 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPSPDSDQGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3519 - protein, 487 aa, Artificial sequence
  PD-L2 1417 - CTLA-4 3495 - Fc
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSGGSGGGGSGGGGSKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPSPDSDQGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3520 - protein, 500 aa, Artificial sequence
  CTLA-4 2655 - PD-L1 303 - Fc
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3521 - protein, 500 aa, Artificial sequence
  PD-L1 303 - CTLA-4 2655 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3522 - protein, 499 aa, Artificial sequence
  CTLA-4 3037 - PD-L1 303 -Fc
KAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSDGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3523 - protein, 499 aa, Artificial sequence
  PD-L1 303 - CTLA-4 3037 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSKAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSDGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3524 - protein, 497 aa, Artificial sequence
  PD-L1 303 - Fc - CTLA-4 3037
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSKAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSD

SEQ ID NO: 3525 - protein, 129 aa, Artificial sequence
  PD-L1 303
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNADYKDDDDKHHHHHH

SEQ ID NO: 3526 - protein, 119 aa, Artificial sequence
  PD-L2 1417
LFTVTVPKELYIIEQGSNVTLECNFDTGSHVNLGAITASLQKVENDASPHRERATLLEEQLPLGRALFHIPQVQVRDEGQYRCIIIYGDAWDYKYLTLKVKAGSDYKDDDKGSHHHHHH

SEQ ID NO: 3527 - protein, 136 aa, Artificial sequence
  ICOSL 2266
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVDYKDDDDKHHHHHH

SEQ ID NO: 3528 - protein, 136 aa, Artificial sequence
  ICOSL 2264
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVDYKDDDDKHHHHHH

SEQ ID NO: 3529 - protein, 364 aa, Artificial sequence
  CTLA-4 3037 - Fc
KAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3530 - protein, 364 aa, Artificial sequence
  CTLA-4 36 - Fc
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3531 - protein, 356 aa, Artificial sequence
  PD-L1 303  - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPG

SEQ ID NO: 3532 - protein, 451 aa, Artificial sequence
  huPDL2-Fc
AILALLLAVLQGVSALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTAAAEPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3533 - protein, 243 aa, Artificial sequence
  Stuffer_AAA_ Knob Fc
HMSSVSAQAAAEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3534 - protein, 367 aa, Artificial sequence; identical to SEQ ID NO: 2561
  PD-L1 303  - Fc

SEQ ID NO: 3535 - protein, 266 aa, Artificial sequence; identical to SEQ ID NO: 2607
  PD-L1 303  - ICOSL 2244

SEQ ID NO: 3536 - DNA, 1476 bp, Artificial sequence
  PD-L2 31 - Fc
atggggtcagccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccgatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacggcggccgcagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacgggagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaag

SEQ ID NO: 3537 - protein, 473 aa, Artificial sequence
  PD-L2 31 - Fc
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATAAAEPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3538 - protein, 231 aa, Artificial sequence
  Fc
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3539 - DNA, 1125 bp, Artificial sequence
  PD-L1 303  - Fc
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgagcccaaatcttctgacaaaactcacacatgccccccttgtccagcgcctgaactcctgggtggaccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3540 - protein, 356 aa, Artificial sequence
  PD-L1 303  - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3541 - DNA, 1558 bp, Artificial sequence
  PD-L1 303  - PD-L1 303  - Fc
atggggtcaaccgccatcctcgccctcctcctggctgttctccaaggagtcagcgcttttactgttacggtacccaaagacctgtacgtagtggagtacgggtccaatatgaccatagaatgcaaattccccgtcgagaagcaattggatctcgccgctctgatcgtctactgggagatggagggcaaagatatcattcaattcgtacacggggaagaagatcagaaagctcaacacagctcttacaggcaacgggcgagactgctcaaggaccaattgagtcttggaaacgctgcacttcagatcaccgacgtgaagttgcaggatgcaggcgtgtatcggtgcatgataagctatggaggaggggcagattataaaaggattacggtgaaggtaaacgcaggtggcggaggttctggcggaggtggaagtggcggaggtggctctttcacagtaacggtccctaaagatctctatgtcgtggaatacgggagcaacatgacaattgagtgcaagtttccagtagaaaagcaacttgatctggccgcgttgatagtctactgggagatggaaggtaaggacatcattcagtttgtacatggagaggaagaccaaaaggctcagcatagttcctatcggcagagggcgagattgcttaaagaccagctctccttgggaaatgcagctctccagattacggatgtgaaattgcaagatgctggcgtatacagatgtatgattagctatggaggaggtgcggactataagagaatcacggtcaaagttaatgccgggtctgggggaggcggttctgagcccaaatcttctgacaaaactcacacatgccccccttgtccagcgcctgaactcctgggtggaccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggtaagatatctcgacaatcaacctctggattacaaaatttgtgaaagattgac

SEQ ID NO: 3542 - protein, 483 aa, Artificial sequence
  PD-L1 303  - PD-L1 303  - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3543 - DNA, 798 bp, artificial sequence
  PD-L1 303  ICOSL 2264
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcac

SEQ ID NO: 3544 - DNA, 798 bp, artificial sequence
  PD-L1 303  ICOSL 2266
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcac

SEQ ID NO: 3545 - DNA, 759 bp, artificial sequence
  PD-L2 1417  ICOSL 2266:
ttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcac

SEQ ID NO: 3546 - DNA, 759 bp, artificial sequence
  PD-L2 1417  ICOSL 2264:
ttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtggattacaaggatgacgacgataagcaccatcatcaccatcac

SEQ ID NO: 3547 - DNA, 1599 bp, Artificial sequence
  PD-L1 303  PD-L1 303  ICOSL 2264  ICOSL 2264
tttacagtaacagtacccaaagacctgtatgtcgtcgaatacgggtcaaacatgactattgagtgtaaattcccggtagaaaagcaacttgatctggcagccctgattgtatattgggaaatggagggcaaggatataatccaatttgttcacggcgaggaggatcagaaagcacagcactcttcatataggcagagggcacgcctgctgaaagatcaacttagtctgggtaatgcagccttgcaaattacagatgttaagttacaggatgcgggtgtgtaccggtgtatgattagttacggcggaggagcagattataaacggatcaccgttaaggtgaacgccggaggtggtggatcaggtggaggaggttccggaggaggtggatcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggtggaggtggctctggaggtggtggaagcggtggcggtggtagcgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggatccggagggtctgggggaggcggttctgggggtggaggctcagatactcaggaaaaggaagtgagagcaatggttgggtcagatgtggaattgagctgtgcatgccccgaaggaagtagattcgatctcaatgatgtctatgtgtactggcaaaccagcgagagcaagactgtggtaacctatcacattccgcaacacagttcacttgaatatgtggatagccggtaccgaaatcgggctcttatgtctccggcagggatgcttaggggtgacttttccttgagacttttcaacgtcactcctcaggacgagcagaaattccattgtcttgtcctgtctcggtccttggggtttcaggaagtgctgtctgtagaggtgacgctgcacgtcgctgctaactttagcgtggattacaaggatgacgacgataagcaccatcatcaccatcac

SEQ ID NO: 3548 - DNA, 1188 bp, Artificial sequence
  PD-L1 303  ICOSL 2264   PD-L1 303
tttacagtaacagtacccaaagacctgtatgtcgtcgaatacgggtcaaacatgactattgagtgtaaattcccggtagaaaagcaacttgatctggcagccctgattgtatattgggaaatggagggcaaggatataatccaatttgttcacggcgaggaggatcagaaagcacagcactcttcatataggcagagggcacgcctgctgaaagatcaacttagtctgggtaatgcagccttgcaaattacagatgttaagttgcaggatgcgggtgtgtaccggtgtatgattagttacggcggaggagcagattataaacggatcaccgttaaggtgaacgccggaggtggtggatcaggtggaggaggttccggaggaggtggatctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggtggctctggaggtggtggaagcggtggcggtggtagctttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcac

SEQ ID NO: 3549 - DNA, 1599 bp, Artificial sequence
  PD-L1 303   ICOSL 2264  ICOSL 2264   PD-L1 303
tttacagtaacagtacccaaagacctgtatgtcgtcgaatacgggtcaaacatgactattgagtgtaaattcccggtagaaaagcaacttgatctggcagccctgattgtatattgggaaatggagggcaaggatataatccaatttgttcacggcgaggaggatcagaaagcacagcactcttcatataggcagagggcacgcctgctgaaagatcaacttagtctgggtaatgcagccttgcaaattacagatgttaagttgcaggatgcgggtgtgtaccggtgtatgattagttacggcggaggagcagattataaacggatcaccgttaaggtgaacgccggaggtggtggatcaggtggaggaggttccggaggaggtggatctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggtggctctggaggtggtggaagcggtggcggtggtagcgatactcaggaaaaggaagtgagagcaatggttgggtcagatgtggaattgagctgtgcatgccccgaaggaagtagattcgatctcaatgatgtctatgtgtactggcaaaccagcgagagcaagactgtggtaacctatcacattccgcaacacagttcacttgaatatgtggatagccggtaccgaaatcgggctcttatgtctccggcagggatgcttaggggtgacttttccttgagacttttcaacgtcactcctcaggacgagcagaaattccattgtcttgtcctgtctcggtccttggggtttcaggaagtgctgtctgtagaggtgacgctgcacgtcgctgctaactttagcgtgggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcac

SEQ ID NO: 3550 - DNA, 567 bp, Artificial sequence
  PD-L1 303  COMP
tttacagtaacagtacccaaagacctgtatgtcgtcgaatacgggtcaaacatgactattgagtgtaaattcccggtagaaaagcaacttgatctggcagccctgattgtatattgggaaatggagggcaaggatataatccaatttgttcacggcgaggaggatcagaaagcacagcactcttcatataggcagagggcacgcctgctgaaagatcaacttagtctgggtaatgcagccttgcaaattacagatgttaagttgcaggatgcgggtgtgtaccggtgtatgattagttacggcggaggagcagattataaacggatcaccgttaaggtgaacgccggaggtggtggatcaggtggaggaggttccggaggaggtggatctgatttgggtccacaaatgctgagggagttgcaggagacaaatgccgctttgcaagacgttagagagcttctgagacaacaagtgcgcgagatcacgttcttgaagaacacagttatggaatgcgacgcttgcggcgattacaaggatgacgacgataagcaccatcatcaccatcac

SEQ ID NO: 3551 - DNA, 978 bp, Artificial sequence
  PD-L1 303  ICOSL 2264 COMP
tttacagtaacagtacccaaagacctgtatgtcgtcgaatacgggtcaaacatgactattgagtgtaaattcccggtagaaaagcaacttgatctggcagccctgattgtatattgggaaatggagggcaaggatataatccaatttgttcacggcgaggaggatcagaaagcacagcactcttcatataggcagagggcacgcctgctgaaagatcaacttagtctgggtaatgcagccttgcaaattacagatgttaagttgcaggatgcgggtgtgtaccggtgtatgattagttacggcggaggagcagattataaacggatcaccgttaaggtgaacgccggaggtggtggatcaggtggaggaggttccggaggaggtggatctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggtggctctggaggtggtggaagcggtggcggtggtagcgatttgggtccacaaatgctgagggagttgcaggagacaaatgccgctttgcaagacgttagagagcttctgagacaacaagtgcgcgagatcacgttcttgaagaacacagttatggaatgcgacgcttgcggcgattacaaggatgacgacgataagcaccatcatcaccatcac

SEQ ID NO: 3552 - DNA, 531 bp, Artificial sequence
  PD-L1 303  VASP
tttactgttacggtacccaaagacctgtacgtagtggagtacgggtccaatatgaccatagaatgcaaattccccgtcgagaagcaattggatctcgccgctctgatcgtctactgggagatggagggcaaagatatcattcaattcgtacacggggaagaagatcagaaagctcaacacagctcttacaggcaacgggcgagactgctcaaggaccaattgagtcttggaaacgctgcacttcagatcaccgacgtgaagttgcaggatgcaggcgtgtatcggtgcatgataagctatggaggaggggcagattataaaaggattacggtgaaggtaaacgcaggtggcggaggttctggcggaggtggaagtggcggaggtggctctgatctccagagggtcaaacaagagctgcttgaagaggtgaaaaaggagcttcagaaggttaaagaagaaattatagaggcattcgttcaagaattgagagactataaagatgacgacgacaaacaccatcatcaccatcac

SEQ ID NO: 3553 - DNA, 942 bp, Artificial sequence
  PD-L1 303  ICOSL 2264  VASP
tttactgttacggtacccaaagacctgtacgtagtggagtacgggtccaatatgaccatagaatgcaaattccccgtcgagaagcaattggatctcgccgctctgatcgtctactgggagatggagggcaaagatatcattcaattcgtacacggggaagaagatcagaaagctcaacacagctcttacaggcaacgggcgagactgctcaaggaccaattgagtcttggaaacgctgcacttcagatcaccgacgtgaagttgcaggatgcaggcgtgtatcggtgcatgataagctatggaggaggggcagattataaaaggattacggtgaaggtaaacgcaggtggcggaggttctggcggaggtggaagtggcggaggtggctctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggtggtgggagtgggggcgggggttcaggaggcggcggctctgatctccagagggtcaaacaagagctgcttgaagaggtgaaaaaggagcttcagaaggttaaagaagaaattatagaggcattcgttcaagaattgagagactataaagatgacgacgacaaacaccatcatcaccatcac

SEQ ID NO: 3554 - DNA, 525 bp, Artificial sequence
  ZZ12.6  PD-L1 303
gactataaagatgacgacgacaaacaccatcatcaccatcacggtggcggaggttcttccgacgtccaggcgatctcctccaccatccaggaccttcaggaccaggtcgactccctggcggaggtggtgctgcagaatcgccgcggccttgaccttcttacgagaagcggcggtggatcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgcc

SEQ ID NO: 3555 - DNA, 552 bp, Artificial sequence
  PD-L1 303  ZZ12.6
tttactgttacggtacccaaagacctgtacgtagtggagtacgggtccaatatgaccatagaatgcaaattccccgtcgagaagcaattggatctcgccgctctgatcgtctactgggagatggagggcaaagatatcattcaattcgtacacggggaagaagatcagaaagctcaacacagctcttacaggcaacgggcgagactgctcaaggaccaattgagtcttggaaacgctgcacttcagatcaccgacgtgaagttgcaggatgcaggcgtgtatcggtgcatgataagctatggaggaggggcagattataaaaggattacggtgaaggtaaacgcaggtggcggaggttctggcggaggtggaagtggcggaggtggctctgacgtccaggcgatctcctccaccatccaggaccttcaggaccaggtcgactccctggcggaggtggtgctgcagaatcgccgcggccttgaccttcttacgagaagcggcggtggatcagactataaagatgacgacgacaaacaccatcatcaccatcac

SEQ ID NO: 3556 - DNA, 1488 bp, Artificial sequence
  PD-L1 303   ICOSL 2266  Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggagggtcaggatccgggggaggtggaagcgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtgcagagaagaaatgaccaagaatcaagtttccctgtggtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggaag

SEQ ID NO: 3557 - DNA, 729 bp, Artificial sequence
  Hole Fc
cacatgtcttcggtaagtgcacaggcggccgcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttgcactttgcccccgtcaagagaagaaatgaccaagaatcaagtttccctgtcttgcgcagtgaagggcttctaccctagcgatatagcagttgagtgggaatctaacggccagcccgaaaataattataagactactccgcccgtgctggacagtgatggttcatttttcctggtttcaaaactcactgtggacaaatctagatggcagcagggtaatgtgttctcttgttcagttatgcacgaggcattgcacaatcactatacgcaaaaaagtttgtctctctctccggggaag

SEQ ID NO: 3558 - DNA, 1488 bp, Artificial sequence
  PD-L1 303   ICOSL 2264  Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggagggtcaggatccgggggaggtggaagcgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtgcagagaagaaatgaccaagaatcaagtttccctgtggtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggaag

SEQ ID NO: 3559 - DNA, 1485 bp, Artificial sequence
  PD-L1 303  ICOSL 2266  Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggtgggtcaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3560 - DNA, 1485 bp, Artificial sequence
  PD-L1 303  ICOSL 2264 Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggtgggtcaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3561 - DNA, 1500 bp, Artificial sequence
  PD-L1 303  CTLA-4 3495  Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcaaaggcgatgcacgtagcccagcccgctgttgttctcgcaagttctcgcggcatagcctccttcgtatgtgagtatgccagtccaggtaaggcaacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatctgggcattggaaatggaacacaaatctatgttattgacccggagccgtctccagatagtgatcagggtggaggtgggtcaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3562 - DNA, 1461 bp, Artificial sequence
  PD-L2 1417  CTLA-4 3495  Fc
ttattcacagtgactgttcctaaggaactgtacataatagagcaaggcagcaatgtgaccctggaatgcaactttgacactggaagtcatgtgaaccttggagcaataacagccagtttgcaaaaggtggagaatgatgcatccccacaccgtgaaagagccactttgctggaggagcagctgcccctagggagggccttgttccacatacctcaagtccaagtgagggacgaaggacagtaccgatgcataatcatctatggggacgcctgggactacaagtacttgactctcaaagttaaagctggatccggagggtctgggggaggcggttctgggggtggaggctcaaaggcgatgcacgtagcccagcccgctgttgttctcgcaagttctcgcggcatagcctccttcgtatgtgagtatgccagtccaggtaaggcaacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaacctgaccatccaaggtctgagggcgatggatacgggtctttatatttgcaaggttgaactcatgtatccgcctccatactatctgggcattggaaatggaacacaaatctatgttattgacccggagccgtctccagatagtgatcagggtggaggtgggtcaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3563 - DNA, 1500 bp, Artificial sequence
  CTLA-4 2655  PD-L1 303  Fc
aaggcgatgcacgtagcccagcccgctgttgttctcgcaagttctcgcggcatagcctccttcgtatgtgagtatgccagtccaggtaaggcaacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatctgggcattggaaatggaacacaaatctatgttattgacccggagccgtgtccagatagtgatcagggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggcggaggtggttccggatccggtggaggaggctccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3564 - DNA, 1500 bp, Artificial sequence
  PD-L1 303  CTLA-4 2655  Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcaaaggcgatgcacgtagcccagcccgctgttgttctcgcaagttctcgcggcatagcctccttcgtatgtgagtatgccagtccaggtaaggcaacggaggtacgggtaactgtactgcggcaggccgattcccaggttacggaggtttgtgcggcaacctacatgatgggtaacgagcttacatttctcgacgactcaatatgtactgggacctcctcaggaaatcaggtcaatctgaccatccaaggtctgagggcgatggatacgggtctttatatttgcaaggttgaactcatgtatccgcctccatactatctgggcattggaaatggaacacaaatctatgttattgacccggagccgtgtccagatagtgatcagggcggaggtggttccggatccggtggaggaggctccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3565 - DNA, 1497 bp, Artificial sequence
  CTLA-4 3037  PD-L1 303 Fc
aaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgacggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggcggaggtggttccggatccggtggaggaggctccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3566 - DNA, 1497 bp, Artificial sequence
  PD-L1 303  CTLA-4 3037  Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcaaaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgacggcggaggtggttccggatccggtggaggaggctccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3567 - DNA, 1482 bp, Artificial sequence
  PD-L1 303  Fc - CTLA-4 3037
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgggtctgggggaggcggttctgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggggtggaggtggctctggaggtggtggaagcggtggcggtggtagcaaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgac

SEQ ID NO: 3568 - DNA, 387 bp, Artificial sequence
  PD-L1 303
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccgattacaaggatgacgacgataagcaccatcatcaccatcac

SEQ ID NO: 3569 - DNA, 360 bp, Artificial sequence
  PD-L2 1417
ttattcacagtgacagtccctaaggaactgtacataatagagcaaggcagcaatgtgaccctggaatgcaactttgacactggaagtcatgtgaaccttggagcaataacagccagtttgcaaaaggtggaaaatgatgcttccccacaccgtgaaagagccactttgctggaggagcagctgcccctagggagggccttattccacatacctcaagtccaagtgagggacgaaggacagtacaggtgcataatcatctatggggacgcctgggactacaagtacctgactctgaaagtcaaagctggatcagattacaaggatgacgacgataagggatctcaccatcatcaccatcac

SEQ ID NO: 3570 - DNA, 408 bp, Artificial sequence
  ICOSL 2266
gatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccgatccctgggattccaggaggttttgagcgttgaggttacactgcatgtggcagcaaacttcagcgtggattacaaggatgacgacgataagcaccatcatcaccatcac

SEQ ID NO: 3571 - DNA, 408 bp, Artificial sequence
  ICOSL 2264
gatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatacgtggacagccgctaccggaaccgagccctgatgtcaccggccggcatgctgcggggcgacttctccctgcgcttgttcaacgtcaccccccaggacgagcagaagtttcactgcctggtgttgagccgatccctgggattccaggaggttttgagcgttgaggttacactgcatgtggcagcaaacttcagcgtggattacaaggatgacgacgataagcaccatcatcaccatcac

SEQ ID NO: 3572 - DNA, 1092 bp, Artificial sequence
  CTLA-4 3037  Fc
aaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgacggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3573 - DNA, 1092 bp, Artificial sequence
  CTLA-4 36  Fc
aaagcgatgcacgtcgcccagcctgctgtcgtactcgctagctcacgcggcatcgcaagtttcgtatgcgaatatgcctctccaggaaaagcgaccgaggtcagagttactgtactgagacaagctgattcacaagtgactgaggtctgcgctgctacttatatgatggggaacgagctgactttccttgatgactcaatctgtaccggcaccagcagtgggaaccaagtaaatcttactattcaaggactgagggcaatggacacgggactttacatttgtaaggtcgagctgatgtacccgccaccttactacctcggaatcggtaatggtacgcaaatttatgttatagatcctgaaccgtgccccgattccgacggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3574 - DNA, 1059 bp, Artificial sequence
  PD-L1 303   Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3575 - DNA, 1308 bp, Artificial sequence
  huPDL2-Fc
ttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtcagatggaacccaggacccatccaactgcggccgcagagcccaaatcttctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaag

SEQ ID NO: 3576 - DNA, 720 bp, Artificial sequence
  Stuffer_AAA_ Knob Fc
cacatgtcttcggtaagtgcacaagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtgcagagaagaaatgaccaagaatcaagtttccctgtggtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggaag

SEQ ID NO: 3577 - DNA, 1101 bp, Artificial sequence
  PD-L1 303  Fc
tttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttgcactttgcccccgtcaagagaagaaatgaccaagaatcaagtttccctgtcttgcgcagtgaagggcttctaccctagcgatatagcagttgagtgggaatctaacggccagcccgaaaataattataagactactccgcccgtgctggacagtgatggttcatttttcctggtttcaaaactcactgtggacaaatctagatggcagcagggtaatgtgttctcttgttcagttatgcacgaggcattgcacaatcactatacgcaaaaaagtttgtctctctctccggggcaccatcatcaccatcac

SEQ ID NO: 3578 - DNA, 798 bp, Artificial sequence; identical to SEQ ID NO: 3543
  PD-L1 303   ICOSL 2244

SEQ ID NO: 3579 - protein, 232 aa, Artificial Sequence; identical to SEQ ID NO: 1155
  Fc (C220S/L234A/L235E/G237A/E356D/M358L )

SEQ ID NO: 3580 - protein, 107 aa, Homo sapiens
  MISC_FEATURE: Wildtype CD80 IgV
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKAD

SEQ ID NO: 3581 - DNA, 1062 bp, Artificial sequence
  PD-L2 1417_GSGGS_2xG4S_ Hole Fc_His
ttattcacagtgactgttccgaaagagttgtatataatcgagcaagggagtaatgttaccctggaatgcaattttgacaccgggtcacacgtcaacctcggagcgattactgcttctttgcaaaaagttgaaaacgacgcgtccccccatagggaaagggcgacccttctggaggagcagttgccccttggcagggcactctttcacattccccaggtgcaagtcagggacgaggggcaataccgctgcatcataatttacggggacgcgtgggactacaagtacttgactctcaaagttaaagctggatccggagggtctgggggaggcggttctgggggtggaggctcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttgcactttgcccccgtcaagagaagaaatgaccaagaatcaagtttccctgtcttgcgcagtgaagggcttctaccctagcgatatagcagttgagtgggaatctaacggccagcccgaaaataattataagactactccgcccgtgctggacagtgatggttcatttttcctggtttcaaaactcactgtggacaaatctagatggcagcagggtaatgtgttctcttgttcagttatgcacgaggcattgcacaatcactatacgcaaaaaagtttgtctctctctccggggcaccatcatcaccatcac

SEQ ID NO: 3582 - protein, 126 aa, Artificial sequence
  T89A/L98Q/M99L/Y105L/L106I/Y115N/E120D/C122P/D124P/S125I/D126P ECD
KAMHVAQPAVVLASSRGIASFVCEYASPGKATEVRVTVLRQADSQVTEVCAATYMMGNELTFLDDSICTGTSSGNQVNLTIQGLRAMDAGLYICKVEQLYPPPYLIGIGNGTQINVIDPDPPPPIP

SEQ ID NO: 3583 - protein, 126 aa, Artificial sequence
  N58S/L63P/T71A/S72G/L98Q/M99L/Y105L/D124I/S125P/D126T ECD
KAMHVAQPAVVLASSRGIASFVCEYASPGKATEVRVTVLRQADSQVTEVCAATYMMGSELTFPDDSICTGAGSGNQVNLTIQGLRAMDTGLYICKVEQLYPPPYLLGIGNGTQIYVIDPEPCPIPT

SEQ ID NO: 3584 - protein, 126 aa, Artificial sequence
  R16G/E33M/N58S/E59G/L63P/L98Q/Y105L/E120D/C122P/D124P/S125I/D126P ECD
KAMHVAQPAVVLASSGGIASFVCEYASPGKATMVRVTVLRQADSQVTEVCAATYMMGSGLTFPDDSICTGTSSGNQVNLTIQGLRAMDTGLYICKVEQMYPPPYLLGIGNGTQIYVIDPDPPPPIP

SEQ ID NO: 3585 - protein, 126 aa, Artificial sequence
  G29W/L63P/S72G/L98Q/Y105L/P121S/D126T ECD
KAMHVAQPAVVLASSRGIASFVCEYASPWKATEVRVTVLRQADSQVTEVCAATYMMGNELTFPDDSICTGTGSGNQVNLTIQGLRAMDTGLYICKVEQMYPPPYLLGIGNGTQIYVIDPESCPDST

SEQ ID NO: 3586 - protein, 126 aa, Artificial sequence
  L12H/E33M/L98Q/Y105L ECD
KAMHVAQPAVVHASSRGIASFVCEYASPGKATMVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 3587 - protein, 126 aa, Artificial sequence
  T53S/M56K/N58S/L63P/M87V/L98Q/Y105L ECD
KAMHVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYLLGIGNGTQIYVIDPEPCPDSD

SEQ ID NO: 3588 - protein, 126 aa, Artificial sequence
  I18T/A26T/M55T/M56K/L63P/L98Q/M99L/Y105L ECD
KAMHVAQPAVVLASSRGTASFVCEYTSPGKATEVRVTVLRQADSQVTEVCAATYTKGNELTFPDDSICTGTSSGNQVNLTIQGLRAMDTGLYICKVEQLYPPPYLLGIGNGTQIYVIDPEPCPDSD

SEQ ID NO: 3589 - protein, 126 aa, Artificial sequence
  I18T/A26T/M56K/L63P/L98Q/Y105L ECD
KAMHVAQPAVVLASSRGTASFVCEYTSPGKATEVRVTVLRQADSQVTEVCAATYMKGNELTFPDDSICTGTSSGNQVNLTIQGLRAMDTGLYICKVEQMYPPPYLLGIGNGTQIYVIDPEPCPDSD

SEQ ID NO: 3590 - protein, 126 aa, Artificial sequence
  T53S/L63P/L98Q ECD
KAMHVAQPAVVLASSRGIASFVCEYASPGKATEVRVTVLRQADSQVTEVCAASYMMGNELTFPDDSICTGTSSGNQVNLTIQGLRAMDTGLYICKVEQMYPPPYYLGIGNGTQIYVIDPEPCPDSD

SEQ ID NO: 3591 - protein, 126 aa, Artificial sequence
  T53S/L63P/Y105L ECD
KAMHVAQPAVVLASSRGIASFVCEYASPGKATEVRVTVLRQADSQVTEVCAASYMMGNELTFPDDSICTGTSSGNQVNLTIQGLRAMDTGLYICKVELMYPPPYLLGIGNGTQIYVIDPEPCPDSD

SEQ ID NO: 3592 - protein, 126 aa, Artificial sequence
  T53S/M56K/N58S/L63P/M87V/L98Q ECD
KAMHVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYYLGIGNGTQIYVIDPEPCPDSD

SEQ ID NO: 3593 - protein, 126 aa, Artificial sequence
  T53S/M56K/N58S/L63P/M87V/Y105L ECD
KAMHVAQPAVVLASSRGIASFVCEYASPGKATEVRVTVLRQADSQVTEVCAASYMKGSELTFPDDSICTGTSSGNQVNLTIQGLRAVDTGLYICKVELMYPPPYLLGIGNGTQIYVIDPEPCPDSD

SEQ ID NO: 3594 - protein, 126 aa, Artificial sequence
  T53S/M56K/N58S/L63P/L98Q/Y105L ECD
KAMHVAQPAVVLASSRGIASFVCEYASPGKATEVRVTVLRQADSQVTEVCAASYMKGSELTFPDDSICTGTSSGNQVNLTIQGLRAMDTGLYICKVEQMYPPPYLLGIGNGTQIYVIDPEPCPDSD

SEQ ID NO: 3595 - protein, 126 aa, Artificial sequence
  T53S/M56K/N58S/M87V/L98Q/Y105L ECD
KAMHVAQPAVVLASSRGIASFVCEYASPGKATEVRVTVLRQADSQVTEVCAASYMKGSELTFLDDSICTGTSSGNQVNLTIQGLRAVDTGLYICKVEQMYPPPYLLGIGNGTQIYVIDPEPCPDSD

SEQ ID NO: 3596 - protein, 126 aa, Artificial sequence
  T53S/M56K/L63P/M87V/L98Q/Y105L ECD
KAMHVAQPAVVLASSRGIASFVCEYASPGKATEVRVTVLRQADSQVTEVCAASYMKGNELTFPDDSICTGTSSGNQVNLTIQGLRAVDTGLYICKVEQMYPPPYLLGIGNGTQIYVIDPEPCPDSD

SEQ ID NO: 3597 - protein, 126 aa, Artificial sequence
  T53S/N58S/L63P/M87V/L98Q/Y105L ECD
KAMHVAQPAVVLASSRGIASFVCEYASPGKATEVRVTVLRQADSQVTEVCAASYMMGSELTFPDDSICTGTSSGNQVNLTIQGLRAVDTGLYICKVEQMYPPPYLLGIGNGTQIYVIDPEPCPDSD

SEQ ID NO: 3598 - protein, 126 aa, Artificial sequence
  M56K/N58S/L63P/M87V/L98Q/Y105L ECD
KAMHVAQPAVVLASSRGIASFVCEYASPGKATEVRVTVLRQADSQVTEVCAATYMKGSELTFPDDSICTGTSSGNQVNLTIQGLRAVDTGLYICKVEQMYPPPYLLGIGNGTQIYVIDPEPCPDSD

SEQ ID NO: 3599 - protein, 126 aa, Artificial sequence
  E33V/L98Q/Y105L ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 3600 - protein, 126 aa, Artificial sequence
  E33V/M99L/Y105L ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYLLGIGNGTQIYVIDPEPCPDSD

SEQ ID NO: 3601 - protein, 126 aa, Artificial sequence
  E33V/L98Q/M99L  ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVEQLYPPPYYLGIGNGTQIYVIDPEPCPDSD

SEQ ID NO: 3602 - protein, 126 aa, Artificial sequence
  E33V/M99L ECD
KAMHVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYYLGIGNGTQIYVIDPEPCPDSD

SEQ ID NO: 3603 - protein, 126 aa, Artificial sequence
  L12F/R16H/G29W/M56T/L98Q ECD
KAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYYLGIGNGTQIYVIDPEPCPDSD

SEQ ID NO: 3604 - protein, 126 aa, Artificial sequence
  L12F/R16H/G29W/M56T/Y105L ECD
KAMHVAQPAVVFASSHGIASFVCEYASPWKATEVRVTVLRQADSQVTEVCAATYMTGNELTFLDDSICTGTSSGNQVNLTIQGLRAMDTGLYICKVELMYPPPYLLGIGNGTQIYVIDPEPCPDSD

SEQ ID NO: 3605 - protein, 126 aa, Artificial sequence
  L12F/R16H/G29W/L98Q/Y105L ECD
KAMHVAQPAVVFASSHGIASFVCEYASPWKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 3606 - protein, 126 aa, Artificial sequence
  L12F/R16H/M56T/L98Q/Y105L ECD
KAMHVAQPAVVFASSHGIASFVCEYASPGKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 3607 - protein, 126 aa, Artificial sequence
  G29W/M56T/L98Q/Y105L ECD
KAMHVAQPAVVLASSRGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 3608 - protein, 126 aa, Artificial sequence
  L12F/G29W/L98Q/Y105L ECD
KAMHVAQPAVVFASSRGIASFVCEYASPWKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 3609 - protein, 126 aa, Artificial sequence
  L12F/L98Q/Y105L ECD
KAMHVAQPAVVFASSRGIASFVCEYASPGKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 3610 - protein, 126 aa, Artificial sequence
  R16H/L98Q/Y105L ECD
KAMHVAQPAVVLASSHGIASFVCEYASPGKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 3611 - protein, 126 aa, Artificial sequence
  G29W/L98Q/Y105L ECD
KAMHVAQPAVVLASSRGIASFVCEYASPWKATEVRVTVLRQADSQVTEVCAATYMMGNELTFLDDSICTGTSSGNQVNLTIQGLRAMDTGLYICKVEQMYPPPYLLGIGNGTQIYVIDPEPCPDSD

SEQ ID NO: 3612 - protein, 126 aa, Artificial sequence
  M56T/L98Q/Y105L ECD
KAMHVAQPAVVLASSRGIASFVCEYASPGKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSD

SEQ ID NO: 3613 - protein, 126 aa, Artificial sequence
  L12F/R16H/G29W/M56T/S72G/L98Q/Y105L ECD
KAMHVAQPAVVFASSHGIASFVCEYASPWKATEVRVTVLRQADSQVTEVCAATYMTGNELTFLDDSICTGTGSGNQVNLTIQGLRAMDTGLYICKVEQMYPPPYLLGIGNGTQIYVIDPEPCPDSD

SEQ ID NO: 3614 - protein, 126 aa, Artificial sequence
  G29W/M56T/S72G/L98Q/Y105L ECD
KAMHVAQPAVVLASSRGIASFVCEYASPWKATEVRVTVLRQADSQVTEVCAATYMTGNELTFLDDSICTGTGSGNQVNLTIQGLRAMDTGLYICKVEQMYPPPYLLGIGNGTQIYVIDPEPCPDSD

SEQ ID NO: 3615 - protein, 102 aa, Artificial sequence
  T89A/L98Q/M99L/Y105L/L106I/Y115N/E120D/C122P/D124P/S125I/D126P IgV domain
HVAQPAVVLASSRGIASFVCEYASPGKATEVRVTVLRQADSQVTEVCAATYMMGNELTFLDDSICTGTSSGNQVNLTIQGLRAMDAGLYICKVEQLYPPPYL

SEQ ID NO: 3616 - protein, 102 aa, Artificial sequence
  N58S/L63P/T71A/S72G/L98Q/M99L/Y105L/D124I/S125P/D126T IgV domain
HVAQPAVVLASSRGIASFVCEYASPGKATEVRVTVLRQADSQVTEVCAATYMMGSELTFPDDSICTGAGSGNQVNLTIQGLRAMDTGLYICKVEQLYPPPYL

SEQ ID NO: 3617 - protein, 102 aa, Artificial sequence
  R16G/E33M/N58S/E59G/L63P/L98Q/Y105L/E120D/C122P/D124P/S125I/D126P IgV
HVAQPAVVLASSGGIASFVCEYASPGKATMVRVTVLRQADSQVTEVCAATYMMGSGLTFPDDSICTGTSSGNQVNLTIQGLRAMDTGLYICKVEQMYPPPYL

SEQ ID NO: 3618 - protein, 102 aa, Artificial sequence; identical to SEQ ID NO: 3198
  G29W/L63P/S72G/L98Q/Y105L/P121S/D126T IgV domain

SEQ ID NO: 3619 - protein, 102 aa, Artificial sequence
  L12H/E33M/L98Q/Y105L IgV domain
HVAQPAVVHASSRGIASFVCEYASPGKATMVRVTVLRQADSQVTEVCAATYMMGNELTFLDDSICTGTSSGNQVNLTIQGLRAMDTGLYICKVEQMYPPPYL

SEQ ID NO: 3620 - protein, 102 aa, Artificial sequence
  T53S/M56K/N58S/L63P/M87V/L98Q/Y105L IgV domain
HVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYL

SEQ ID NO: 3621 - protein, 102 aa, Artificial sequence
  I18T/A26T/M55T/M56K/L63P/L98Q/ M99L/Y105L IgV domain
HVAQPAVVLASSRGTASFVCEYTSPGKATEVRVTVLRQADSQVTEVCAATYTKGNELTFPDDSICTGTSSGNQVNLTIQGLRAMDTGLYICKVEQLYPPPYL

SEQ ID NO: 3622 - protein, 102 aa, Artificial sequence
  I18T/A26T/M56K/L63P/L98Q/Y105L IgV domain
HVAQPAVVLASSRGTASFVCEYTSPGKATEVRVTVLRQADSQVTEVCAATYMKGNELTFPDDSICTGTSSGNQVNLTIQGLRAMDTGLYICKVEQMYPPPYL

SEQ ID NO: 3623 - protein, 102 aa, Artificial sequence
  T53S/L63P/L98Q IgV domain
HVAQPAVVLASSRGIASFVCEYASPGKATEVRVTVLRQADSQVTEVCAASYMMGNELTFPDDSICTGTSSGNQVNLTIQGLRAMDTGLYICKVEQMYPPPYY

SEQ ID NO: 3624 - protein, 102 aa, Artificial sequence
  T53S/L63P/Y105L IgV domain
HVAQPAVVLASSRGIASFVCEYASPGKATEVRVTVLRQADSQVTEVCAASYMMGNELTFPDDSICTGTSSGNQVNLTIQGLRAMDTGLYICKVELMYPPPYL

SEQ ID NO: 3625 - protein, 102 aa, Artificial sequence
  T53S/M56K/N58S/L63P/M87V/L98Q IgV domain
HVAQPAVVLASSRGIASFVCEYASPGKATEVRVTVLRQADSQVTEVCAASYMKGSELTFPDDSICTGTSSGNQVNLTIQGLRAVDTGLYICKVEQMYPPPYY

SEQ ID NO: 3626 - protein, 102 aa, Artificial sequence
  T53S/M56K/N58S/L63P/M87V/Y105L IgV domain
HVAQPAVVLASSRGIASFVCEYASPGKATEVRVTVLRQADSQVTEVCAASYMKGSELTFPDDSICTGTSSGNQVNLTIQGLRAVDTGLYICKVELMYPPPYL

SEQ ID NO: 3627 - protein, 102 aa, Artificial sequence
  T53S/M56K/N58S/L63P/L98Q/Y105L IgV domain
HVAQPAVVLASSRGIASFVCEYASPGKATEVRVTVLRQADSQVTEVCAASYMKGSELTFPDDSICTGTSSGNQVNLTIQGLRAMDTGLYICKVEQMYPPPYL

SEQ ID NO: 3628 - protein, 102 aa, Artificial sequence
  T53S/M56K/N58S/M87V/L98Q/Y105L IgV domain
HVAQPAVVLASSRGIASFVCEYASPGKATEVRVTVLRQADSQVTEVCAASYMKGSELTFLDDSICTGTSSGNQVNLTIQGLRAVDTGLYICKVEQMYPPPYL

SEQ ID NO: 3629 - protein, 102 aa, Artificial sequence
  T53S/M56K/L63P/M87V/L98Q/Y105L IgV domain
HVAQPAVVLASSRGIASFVCEYASPGKATEVRVTVLRQADSQVTEVCAASYMKGNELTFPDDSICTGTSSGNQVNLTIQGLRAVDTGLYICKVEQMYPPPYL

SEQ ID NO: 3630 - protein, 102 aa, Artificial sequence
  T53S/N58S/L63P/M87V/L98Q/Y105L IgV domain
HVAQPAVVLASSRGIASFVCEYASPGKATEVRVTVLRQADSQVTEVCAASYMMGSELTFPDDSICTGTSSGNQVNLTIQGLRAVDTGLYICKVEQMYPPPYL

SEQ ID NO: 3631 - protein, 102 aa, Artificial sequence
  M56K/N58S/L63P/M87V/L98Q/Y105L IgV domain
HVAQPAVVLASSRGIASFVCEYASPGKATEVRVTVLRQADSQVTEVCAATYMKGSELTFPDDSICTGTSSGNQVNLTIQGLRAVDTGLYICKVEQMYPPPYL

SEQ ID NO: 3632 - protein, 102 aa, Artificial sequence
  E33V/L98Q/Y105L IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVEQMYPPPYL

SEQ ID NO: 3633 - protein, 102 aa, Artificial sequence
  E33V/M99L/Y105L IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYL

SEQ ID NO: 3634 - protein, 102 aa, Artificial sequence
  E33V/L98Q/M99L  IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVEQLYPPPYY

SEQ ID NO: 3635 - protein, 102 aa, Artificial sequence
  E33V/M99L IgV domain
HVAQPAVVLASSRGIASFVCEYASPGKATVVRVTVLRQADSQVTEVCAATYMMGNELTFLDDSICTGTSSGNQVNLTIQGLRAMDTGLYICKVELLYPPPYY

SEQ ID NO: 3636 - protein, 102 aa, Artificial sequence
  L12F/R16H/G29W/M56T/L98Q IgV domain
HVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYY

SEQ ID NO: 3637 - protein, 102 aa, Artificial sequence
  L12F/R16H/G29W/M56T/Y105L IgV domain
HVAQPAVVFASSHGIASFVCEYASPWKATEVRVTVLRQADSQVTEVCAATYMTGNELTFLDDSICTGTSSGNQVNLTIQGLRAMDTGLYICKVELMYPPPYL

SEQ ID NO: 3638 - protein, 102 aa, Artificial sequence
  L12F/R16H/G29W/L98Q/Y105L IgV domain
HVAQPAVVFASSHGIASFVCEYASPWKATEVRVTVLRQADSQVTEVCAATYMMGNELTFLDDSICTGTSSGNQVNLTIQGLRAMDTGLYICKVEQMYPPPYL

SEQ ID NO: 3639 - protein, 102 aa, Artificial sequence
  L12F/R16H/M56T/L98Q/Y105L IgV domain
HVAQPAVVFASSHGIASFVCEYASPGKATEVRVTVLRQADSQVTEVCAATYMTGNELTFLDDSICTGTSSGNQVNLTIQGLRAMDTGLYICKVEQMYPPPYL

SEQ ID NO: 3640 - protein, 102 aa, Artificial sequence
  G29W/M56T/L98Q/Y105L IgV domain
HVAQPAVVLASSRGIASFVCEYASPWKATEVRVTVLRQADSQVTEVCAATYMTGNELTFLDDSICTGTSSGNQVNLTIQGLRAMDTGLYICKVEQMYPPPYL

SEQ ID NO: 3641 - protein, 102 aa, Artificial sequence
  L12F/G29W/L98Q/Y105L IgV domain
HVAQPAVVFASSRGIASFVCEYASPWKATEVRVTVLRQADSQVTEVCAATYMMGNELTFLDDSICTGTSSGNQVNLTIQGLRAMDTGLYICKVEQMYPPPYL

SEQ ID NO: 3642 - protein, 102 aa, Artificial sequence
  L12F/L98Q/Y105L IgV domain
HVAQPAVVFASSRGIASFVCEYASPGKATEVRVTVLRQADSQVTEVCAATYMMGNELTFLDDSICTGTSSGNQVNLTIQGLRAMDTGLYICKVEQMYPPPYL

SEQ ID NO: 3643 - protein, 102 aa, Artificial sequence
  R16H/L98Q/Y105L IgV domain
HVAQPAVVLASSHGIASFVCEYASPGKATEVRVTVLRQADSQVTEVCAATYMMGNELTFLDDSICTGTSSGNQVNLTIQGLRAMDTGLYICKVEQMYPPPYL

SEQ ID NO: 3644 - protein, 102 aa, Artificial sequence
  G29W/L98Q/Y105L IgV domain
HVAQPAVVLASSRGIASFVCEYASPWKATEVRVTVLRQADSQVTEVCAATYMMGNELTFLDDSICTGTSSGNQVNLTIQGLRAMDTGLYICKVEQMYPPPYL

SEQ ID NO: 3645 - protein, 102 aa, Artificial sequence
  M56T/L98Q/Y105L IgV domain
HVAQPAVVLASSRGIASFVCEYASPGKATEVRVTVLRQADSQVTEVCAATYMTGNELTFLDDSICTGTSSGNQVNLTIQGLRAMDTGLYICKVEQMYPPPYL

SEQ ID NO: 3646 - protein, 102 aa, Artificial sequence
  L12F/R16H/G29W/M56T/S72G/L98Q/Y105L IgV domain
HVAQPAVVFASSHGIASFVCEYASPWKATEVRVTVLRQADSQVTEVCAATYMTGNELTFLDDSICTGTGSGNQVNLTIQGLRAMDTGLYICKVEQMYPPPYL

SEQ ID NO: 3647 - protein, 102 aa, Artificial sequence
  G29W/M56T/S72G/L98Q/Y105L IgV domain
HVAQPAVVLASSRGIASFVCEYASPWKATEVRVTVLRQADSQVTEVCAATYMTGNELTFLDDSICTGTGSGNQVNLTIQGLRAMDTGLYICKVEQMYPPPYL

SEQ ID NO: 3648 - protein, 126 aa, Artificial sequence
  I18T, T61R, L63P, S72G, L98Q, M99L, P102L, Y105L ECD
KAMHVAQPAVVLASSRGTASFVCEYASPGKATEVRVTVLRQADSQVTEVCAATYMMGNELRFPDDSICTGTGSGNQVNLTIQGLRAMDTGLYICKVEQLYPLPYLLGIGNGTQIYVIDPEPCPDSD

SEQ ID NO: 3649 - protein, 102 aa, Artificial sequence
  I18T, T61R, L63P, S72G, L98Q, M99L, P102L, Y105L IgV domain
HVAQPAVVLASSRGTASFVCEYASPGKATEVRVTVLRQADSQVTEVCAATYMMGNELRFPDDSICTGTGSGNQVNLTIQGLRAMDTGLYICKVEQLYPLPYL

SEQ ID NO: 3650 - protein, 94 aa, Homo sapiens
  MISC_FEATURE (1)..(94): CD58 wild type
SQQIYGVVYGNVTFHVPSNVPLKEVLWKKQKDKVAELENSEFRAFSSFKNRVYLDTVSGSLTIYNLTSSDEDEYEMESPNITDTMKFFLYVLES

SEQ ID NO: 3651 - DNA, 1560 bp, Artificial sequence
  CTLA4 3060 - CD155 665 - Fc
atggggtcaaccgccatcctcgccctcctcctggctgttctccaaggagtcagcgctaaagcgatgcacgtcgcccagcctgctgtcgtattcgccagctcacacggcatcgcaagtttcgtatgcgaatatgcctctccatggaaagcgaccgaggtcagagttactgtactgagacaagctgattcacaagtgactgaggtctgcgctgctacttatatgacggggaacgagctgactttccttgatgactcaatctgtaccggcaccagcagtgggaaccaagtaaatcttactattcaaggactgagggcaatggacacgggactttacatttgtaaggtcgagcagatgtacccgccaccttacctcctcggaatcggtaatggtacgcaaatttatgttatagatcctgaaccgtgccccgattccgacggaggtggtggatcaggtggaggaggttccggaggaggtggatcttggccacccccaggaaccggggacgtcgtcgtgcaggcgcccacccaggtgtccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggcccctggtatgcggagtccaaacggctggaattcgtggcagccagactgggcgcggagctgcggaatgcctcgctgagggtgttcgggttgcgcgcagaggatgaaggcaactacacctgccagttcgtcacgttcccgcagcgcagcaggagcgtggatatctggctccgagtgcttggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3652 - protein, 501 aa, Artificial sequence
  CTLA4 3060 - CD155 665 - Fc
KAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSDGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3653 - DNA, 1560 bp, Artificial sequence
  CD155 665 - CTLA4 3037 - Fc
atggggtcaaccgccatcctcgccctcctcctggctgttctccaaggagtcagcgcttggccacccccaggaaccggggacgtcgtcgtgcaggcgcccacccaggtgtccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggcccctggtatgcggagtccaaacggctggaattcgtggcagccagactgggcgcggagctgcggaatgcctcgctgagggtgttcgggttgcgcgcagaggatgaaggcaactacacctgccagttcgtcacgttcccgcagcgcagcaggagcgtggatatctggctccgagtgcttggaggtggtggatcaggtggaggaggttccggaggaggtggatctaaagcgatgcacgtcgcccagcctgctgtcgtattcgccagctcacacggcatcgcaagtttcgtatgcgaatatgcctctccatggaaagcgaccgaggtcagagttactgtactgagacaagctgattcacaagtgactgaggtctgcgctgctacttatatgacggggaacgagctgactttccttgatgactcaatctgtaccggcaccagcagtgggaaccaagtaaatcttactattcaaggactgagggcaatggacacgggactttacatttgtaaggtcgagcagatgtacccgccaccttacctcctcggaatcggtaatggtacgcaaatttatgttatagatcctgaaccgtgccccgattccgacggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3654 - protein, 501 aa, Artificial sequence
  CD155 665 - CTLA4 3037 - Fc
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGGGGSGGGGSGGGGSKAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3655 - DNA, 1719 bp, Artificial sequence
  CD155 665 - CD155 665 - ICOSL 2264 - ICOSL 2264
atggggtcaaccgccatcctcgccctcctcctggctgttctccaaggagtcagcgcttggccacccccaggaaccggggacgtcgtcgtgcaggcgcccacccaggtgtccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggcccctggtatgcggagtccaaacggctggaattcgtggcagccagactgggcgcggagctgcggaatgcctcgctgagggtgttcgggttgcgcgcagaggatgaaggcaactacacctgccagttcgtcacgttcccgcagcgcagcaggagcgtggatatctggctccgagtgcttggaggtggtggatcaggtggaggaggttccggaggaggtggatcttggccgcccccagggaccggcgatgtagtggtccaggcgccaacacaggttagcgggttcctcggcgacagcgtaacactcccgtgctaccttcaagtaccaaacatggaagttacacacgtctcccagctcacttgggctcggcacggagagtccgggtctatggccgtcttccatcagactcagggaccgtggtatgctgagagcaaacggcttgaatttgtggccgcgagattgggcgccgaattgagaaatgcaagcctccgagtcttcgggcttagggctgaggatgaaggcaattacacctgccagtttgtcacattcccccaaaggtcccggtctgtggatatttggctgcgggtccttggtggaggtggctctggaggtggtggaagcggtggcggtggtagcgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggatccggagggtctgggggaggcggttctgggggtggaggctcagatactcaggaaaaggaagtgagagcaatggttgggtcagatgtggaattgagctgtgcatgccccgaaggaagtagattcgatctcaatgatgtctatgtgtactggcaaaccagcgagagcaagactgtggtaacctatcacattccgcaacacagttcacttgaatatgtggatagccggtaccgaaatcgggctcttatgtctccggcagggatgcttaggggtgacttttccttgagacttttcaacgtcactcctcaggacgagcagaaattccattgtcttgtcctgtctcggtccttggggtttcaggaagtgctgtctgtagaggtgacgctgcacgtcgctgctaactttagcgtgggatccggtggaggagggtcagactataaagatgacgacgacaaacaccatcatcaccatcac

SEQ ID NO: 3656 - protein, 554 aa, Artificial sequence
  CD155 665 - CD155 665 - ICOSL 2264 - ICOSL 2264
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGGGSDYKDDDDKHHHHHH

SEQ ID NO: 3657 - DNA, 1719 bp, Artificial sequence
  CD155 665 - ICOSL 2264 - ICOSL 2264 - CD155 665
atggggtcaaccgccatcctcgccctcctcctggctgttctccaaggagtcagcgcttggccacccccaggaaccggggacgtcgtcgtgcaggcgcccacccaggtgtccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggcccctggtatgcggagtccaaacggctggaattcgtggcagccagactgggcgcggagctgcggaatgcctcgctgagggtgttcgggttgcgcgcagaggatgaaggcaactacacctgccagttcgtcacgttcccgcagcgcagcaggagcgtggatatctggctccgagtgcttggaggtggtggatcaggtggaggaggtaccggaggtggtggatctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggaggtggctctggaggtggtggaagcggtggcggtggtagcgatactcaggaaaaggaagtgagagcaatggttgggtcagatgtggaattgagctgtgcatgccccgaaggaagtagattcgatctcaatgatgtctatgtgtactggcaaaccagcgagagcaagactgtggtaacctatcacattccgcaacacagttcacttgaatatgtggatagccggtaccgaaatcgggctcttatgtctccggcagggatgcttaggggtgacttttccttgagacttttcaacgtcactcctcaggacgagcagaaattccattgtcttgtcctgtctcggtccttggggtttcaggaagtgctgtctgtagaggtgacgctgcacgtcgctgctaactttagcgtgggatccggagggtctgggggaggcggttctgggggtggaggctcatggccgcccccagggaccggcgatgtagtggtccaggcgccaacacaggttagcgggttcctcggcgacagcgtaacactcccgtgctaccttcaagtaccaaacatggaagttacacacgtctcccagctcacttgggctcggcacggagagtccgggtctatggccgtcttccatcagactcagggaccgtggtatgctgagagcaaacggcttgaatttgtggccgcgagattgggcgccgaattgagaaatgcaagcctccgagtcttcgggcttagggctgaggatgaaggcaattacacctgccagtttgtcacattcccccaaaggtcccggtctgtggatatttggctgcgggtccttggatccggtggaggagggtcagactataaagatgacgacgacaaacaccatcatcaccatcac

SEQ ID NO: 3658 - protein, 554 aa, Artificial sequence
  CD155 665 - ICOSL 2264 - ICOSL 2264 - CD155 665
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGGGGSGGGGTGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGSGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGSGGGGSDYKDDDDKHHHHHH

SEQ ID NO: 3659 - DNA, 1464 bp, Artificial sequence
  CD155 665 - CD58 3650 - Fc
atggggtcaaccgccatcctcgccctcctcctggctgttctccaaggagtcagcgcttggccacccccaggaaccggggacgtcgtcgtgcaggcgcccacccaggtgtccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggcccctggtatgcggagtccaaacggctggaattcgtggcagccagactgggcgcggagctgcggaatgcctcgctgagggtgttcgggttgcgcgcagaggatgaaggcaactacacctgccagttcgtcacgttcccgcagcgcagcaggagcgtggatatctggctccgagtgcttggaggtggtggatcaggtggaggaggttccggaggaggtggatcttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3660 - protein, 469 aa, Artificial sequence
  CD155 665 - CD58 3650 - Fc
WPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGGGGSGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3661 - DNA, 1464 bp, Artificial sequence
  CD58 3650 - CD155 665 - Fc
atggggtcaaccgccatcctcgccctcctcctggctgttctccaaggagtcagcgcttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctggaggtggtggatcaggtggaggaggttccggaggaggtggatcttggccacccccaggaaccggggacgtcgtcgtgcaggcgcccacccaggtgtccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggcccctggtatgcggagtccaaacggctggaattcgtggcagccagactgggcgcggagctgcggaatgcctcgctgagggtgttcgggttgcgcgcagaggatgaaggcaactacacctgccagttcgtcacgttcccgcagcgcagcaggagcgtggatatctggctccgagtgcttggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3662 - protein, 469 aa, Artificial sequence
  CD58 3650 - CD155 665 - Fc
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3663 - DNA, 1950 bp, Artificial sequence
  PD-L1 303 - CD155 665 - CTLA4 3037 - Fc
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggtggaggtggctctggaggtggtggaagcggtggcggtggtagctggccacccccaggaaccggggacgtcgtcgtgcaggcgcccacccaggtgtccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggcccctggtatgcggagtccaaacggctggaattcgtggcagccagactgggcgcggagctgcggaatgcctcgctgagggtgttcgggttgcgcgcagaggatgaaggcaactacacctgccagttcgtcacgttcccgcagcgcagcaggagcgtggatatctggctccgagtgcttggaggtggtggatcaggtggaggaggttccggaggaggtggatctaaagcgatgcacgtcgcccagcctgctgtcgtattcgccagctcacacggcatcgcaagtttcgtatgcgaatatgcctctccatggaaagcgaccgaggtcagagttactgtactgagacaagctgattcacaagtgactgaggtctgcgctgctacttatatgacggggaacgagctgactttccttgatgactcaatctgtaccggcaccagcagtgggaaccaagtaaatcttactattcaaggactgagggcaatggacacgggactttacatttgtaaggtcgagcagatgtacccgccaccttacctcctcggaatcggtaatggtacgcaaatttatgttatagatcctgaaccgtgccccgattccgacggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3664 - protein, 631 aa, Artificial sequence
  PD-L1 303 - CD155 665 - CTLA4 3037 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSWPPPGTGDVVVQAPTQVSGFLGDSVTLPCYLQVPNMEVTHVSQLTWARHGESGSMAVFHQTQGPWYAESKRLEFVAARLGAELRNASLRVFGLRAEDEGNYTCQFVTFPQRSRSVDIWLRVLGGGGSGGGGSGGGGSKAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3665 - DNA, 1554 bp, Artificial sequence
  CTLA4 3037 - PD-L1 303 - Fc
atggggtcaaccgccatcctcgccctcctcctggctgttctccaaggagtcagcgctaaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgacggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggcggaggtggttccggatccggtggaggaggctccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3666 - protein, 499 aa, Artificial sequence; identical to SEQ ID NO: 3522
  CTLA4 3037 - PD-L1 303 - Fc

SEQ ID NO: 3667 - DNA, 1554 bp, Artificial sequence
  PD-L1 303 - CTLA4 3037 - Fc
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcaaaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgacggcggaggtggttccggatccggtggaggaggctccgagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3668 - protein, 499 aa, Artificial sequence; identical to SEQ ID NO: 3523
  PD-L1 303 - CTLA4 3037 - Fc

SEQ ID NO: 3669 - DNA, 1539 bp, Artificial sequence
  CTLA4 3037 - Fc - PD-L1 303
atggggtcaaccgccatcctcgccctcctcctggctgttctccaaggagtcagcgctaaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgacgggtctgggggaggcggttctgagcccaaaagctccgacaagactcacacatgccccccttgtccagcgcccgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggggtggaggtggctctggaggtggtggaagcggtggcggtggtagctttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgcc

SEQ ID NO: 3670 - protein, 494 aa, Artificial sequence
  CTLA4 3037 - Fc - PD-L1 303
KAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 3671 - DNA, 1542 bp, Artificial sequence
  CTLA4 3037 - Fc - PD-L1 303
atggggtcaaccgccatcctcgccctcctcctggctgttctccaaggagtcagcgctaaagcgatgcacgtcgcccagcctgccgtcgtactcgctagctcacgcggcatcgctagtttcgtatgcgaatatgcctctccatggaaagcgaccgaggtcagagttactgtactgagacaagctgattcacaagtgactgaggtctgcgctgctacttatatgatggggagcgagctgactttccctgatgactcaatctgtaccggcaccagcagtgggaaccaagtaaatcttactattcgaggactgagggcaatggacacgggactttacatttgtaaggtcgagcagatgtacccgccaccttacctcctcggaatcggtaatggtacgcaaatttatgttatagatcctgaaccgtgccccgattccgacgggtctgggggaggcggttctgagcccaaaagctccgacaagactcacacatgccccccttgtccagcgcccgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccggggggtggaggtggctctggaggtggtggaagcggtggcggtggtagcgcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgcc

SEQ ID NO: 3672 - protein, 495 aa, Artificial sequence
  CTLA4 3037 - Fc - PD-L1 303
KAMHVAQPAVVLASSRGIASFVCEYASPWKATEVRVTVLRQADSQVTEVCAATYMMGSELTFPDDSICTGTSSGNQVNLTIRGLRAMDTGLYICKVEQMYPPPYLLGIGNGTQIYVIDPEPCPDSDGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSAFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNA

SEQ ID NO: 3673 - DNA, 1554 bp, Artificial sequence
  CTLA4 3060 - PD-L1 303 - Fc
atggggtcaaccgccatcctcgccctcctcctggctgttctccaaggagtcagcgctaaagcgatgcacgtcgcccagcctgctgtcgtattcgccagctcacacggcatcgcaagtttcgtatgcgaatatgcctctccatggaaagcgaccgaggtcagagttactgtactgagacaagctgattcacaagtgactgaggtctgcgctgctacttatatgacggggaacgagctgactttccttgatgactcaatctgtaccggcaccagcagtgggaaccaagtaaatcttactattcaaggactgagggcaatggacacgggactttacatttgtaaggtcgagcagatgtacccgccaccttacctcctcggaatcggtaatggtacgcaaatttatgttatagatcctgaaccgtgccccgattccgacggatccggagggtctgggggaggcggttctgggggtggaggctcatttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggtggaggtgggtcaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3674 - protein, 499 aa, Artificial sequence
  CTLA4 3060 - PD-L1 303 - Fc
KAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSDGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3675 - DNA, 1554 bp, Artificial sequence
  PD-L1 303 - CTLA4 3060 - Fc
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcaaaagcgatgcacgtcgcccagcctgctgtcgtattcgccagctcacacggcatcgcaagtttcgtatgcgaatatgcctctccatggaaagcgaccgaggtcagagttactgtactgagacaagctgattcacaagtgactgaggtctgcgctgctacttatatgacggggaacgagctgactttccttgatgactcaatctgtaccggcaccagcagtgggaaccaagtaaatcttactattcaaggactgagggcaatggacacgggactttacatttgtaaggtcgagcagatgtacccgccaccttacctcctcggaatcggtaatggtacgcaaatttatgttatagatcctgaaccgtgccccgattccgacggtggaggtgggtcaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3676 - protein, 499 aa, Artificial sequence
  PD-L1 303 - CTLA4 3060 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSKAMHVAQPAVVFASSHGIASFVCEYASPWKATEVRVTVLRQADSQVTEVCAATYMTGNELTFLDDSICTGTSSGNQVNLTIQGLRAMDTGLYICKVEQMYPPPYLLGIGNGTQIYVIDPEPCPDSDGGGGSGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3677 - DNA, 1020 bp, Artificial sequence
  PD-L1 303 - ICOSL 2264 - ZZ12.6
atggggtcaaccgccatcctcgccctcctcctggctgttctccaaggagtcagcgcttttactgttacggtacccaaagacctgtacgtagtggagtacgggtccaatatgaccatagaatgcaaattccccgtcgagaagcaattggatctcgccgctctgatcgtctactgggagatggagggcaaagatatcattcaattcgtacacggggaagaagatcagaaagctcaacacagctcttacaggcaacgggcgagactgctcaaggaccaattgagtcttggaaacgctgcacttcagatcaccgacgtgaagttgcaggatgcaggcgtgtatcggtgcatgataagctatggaggaggggcagattataaaaggattacggtgaaggtaaacgcaggtggcggaggttctggcggaggtggaagtggcggaggtggctctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaatatgtggacagccgctaccggaaccgagccctgatgtcaccggccggcatgctgcggggcgacttctccctgcgcttgttcaacgtcaccccccaggacgagcagaagtttcactgcctggtgttgagcagatccctgggattccaggaggttttgagcgttgaggttacactgcatgtggcagcaaacttcagcgtgggtggcggaggttctggcggaggtggaagtggcggaggtggctctgacgtccaggcgatctcctccaccatccaggaccttcaggaccaggtcgactccctggcggaggtggtgctgcagaatcgccgcggccttgaccttcttacgagaagcggcggtggatcagactataaagatgacgacgacaaacaccatcatcaccatcac

SEQ ID NO: 3678 - protein, 321 aa, Artificial sequence
  PD-L1 303 - ICOSL 2264 - ZZ12.6
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSDVQAISSTIQDLQDQVDSLAEVVLQNRRGLDLLTRSGGGSDYKDDDDKHHHHHH

SEQ ID NO: 3679 - DNA, 1443 bp, Artificial sequence
  CD58 3650 - PD-L1 303 - Fc
atggggtcaaccgccatcctcgccctcctcctggctgttctccaaggagtcagcgcttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctggaggtggtggatcaggtggaggaggttccggaggaggtggatcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3680 - protein, 462 aa, Artificial sequence
  CD58 3650 - PD-L1 303 - Fc
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3681 - DNA, 1443 bp, Artificial sequence
  PD-L1 303 - CD58 3650 - Fc
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggaggtggtggatcaggtggaggaggttccggaggaggtggatcttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 3682 - protein, 462 aa, Artificial sequence
  PD-L1 303 - CD58 3650 - Fc
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 3683 - DNA, 1509 bp, Artificial sequence
  PD-L1 303 - PD-L1 303 - CD58 3650 - CD58 3650
atggggtcaaccgccatcctcgccctcctcctggctgttctccaaggagtcagcgcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggaggtggtggatcaggtggaggaggttccggaggaggtggatctttcacggttacagttcctaaggacttgtatgtagtagagtacggctccaacatgaccatagaatgtaagtttcccgtagaaaagcagttggacttggctgcgttgatagtatattgggaaatggaaggcaaagatatcatccaattcgttcacggtgaagaggaccaaaaggcccagcattcaagttatcgacagagggctagattgctcaaagatcagctctcccttggaaacgcggcgttgcaaataactgacgttaaactccaagatgccggggtctatcgatgtatgatctcttacggtggcggagcggattataaacggataaccgtcaaggtgaacgccggtggaggtggctctggaggtggtggaagcggtggcggtggtagctcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctggatccggagggtctgggggaggcggttctgggggtggaggctcaagccagcagatatatggagtagtatatggaaacgtcacttttcatgttcctagtaacgtacctctgaaagaagtactttggaagaagcagaaggataaagtggctgaattggagaatagcgaatttagagctttttcctcattcaaaaatcgggtctatcttgatacggtctcaggctcacttactatttacaatcttacttctagcgacgaggacgagtacgagatggaatctccgaatatcacagacactatgaaattttttttgtacgtccttgagagcggatccggtggaggagggtcagactataaagatgacgacgacaaacaccatcatcaccatcac

SEQ ID NO: 3684 - protein, 484 aa, Artificial sequence
  PD-L1 303 - PD-L1 303 - CD58 3650 - CD58 3650
FTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGSGGSGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGSGGGGSDYKDDDDKHHHHHH

SEQ ID NO: 3685 - DNA, 1509 bp, Artificial sequence
  CD58 3650 - CD58 3650 - PD-L1 303 - PD-L1 303
atggggtcaaccgccatcctcgccctcctcctggctgttctccaaggagtcagcgcttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctggaggtggtggatcaggtggaggaggttccggaggaggtggatctagccagcagatatatggagtagtatatggaaacgtcacttttcatgttcctagtaacgtacctctgaaagaagtactttggaagaagcagaaggataaagtggctgaattggagaatagcgaatttagagctttttcctcattcaaaaatcgggtctatcttgatacggtctcaggctcacttactatttacaatcttacttctagcgacgaggacgagtacgagatggaatctccgaatatcacagacactatgaaattttttttgtacgtccttgagagcggtggaggtggctctggaggtggtggaagcggtggcggtggtagctttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggatccggagggtctgggggaggcggttctgggggtggaggctcattcacggttacagttcctaaggacttgtatgtagtagagtacggctccaacatgaccatagaatgtaagtttcccgtagaaaagcagttggacttggctgcgttgatagtatattgggaaatggaaggcaaagatatcatccaattcgttcacggtgaagaggaccaaaaggcccagcattcaagttatcgacagagggctagattgctcaaagatcagctctcccttggaaacgcggcgttgcaaataactgacgttaaactccaagatgccggggtctatcgatgtatgatctcttacggtggcggagcggattataaacggataaccgtcaaggtgaacgccggatccggtggaggagggtcagactataaagatgacgacgacaaacaccatcatcaccatcac

SEQ ID NO: 3686 - protein, 484 aa, Artificial sequence
  CD58 3650 - CD58 3650 - PD-L1 303 - PD-L1 303
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGGGSDYKDDDDKHHHHHH

SEQ ID NO: 3687 - DNA, 1509 bp, Artificial sequence
  CD58 3650 - PD-L1 303 - PD-L1 303 - CD58 3650
atggggtcaaccgccatcctcgccctcctcctggctgttctccaaggagtcagcgcttcccaacaaatatatggtgttgtgtatgggaatgtaactttccatgtaccaagcaatgtgcctttaaaagaggtcctatggaaaaaacaaaaggataaagttgcagaactggaaaattctgaattcagagctttctcatcttttaaaaatagggtttatttagacactgtgtcaggtagcctcactatctacaacttaacatcatcagatgaagatgagtatgaaatggaatcgccaaatattactgataccatgaagttctttctttatgtgcttgagtctggaggtggtggatcaggtggaggaggttccggaggaggtggatcttttaccgtaacggtccctaaggatttgtacgtggttgagtacgggagcaatatgacgattgaatgcaagttccccgtagagaagcagctcgatttggccgctttgatagtgtactgggaaatggaaggaaaagacatcattcaattcgtccacggtgaagaggatcaaaaagcgcaacatagctcctatagacaacgcgcacgcttgcttaaagaccagctgagtcttggtaacgcggcgctgcagattaccgacgtaaaacttcaagacgcgggagtttatcgctgcatgatttcctacgggggtggcgcagactataaaaggatcactgtaaaggtaaacgccggtggaggtggctctggaggtggtggaagcggtggcggtggtagcttcacggttacagttcctaaggacttgtatgtagtagagtacggctccaacatgaccatagaatgtaagtttcccgtagaaaagcagttggacttggctgcgttgatagtatattgggaaatggaaggcaaagatatcatccaattcgttcacggtgaagaggaccaaaaggcccagcattcaagttatcgacagagggctagattgctcaaagatcagctctcccttggaaacgcggcgttgcaaataactgacgttaaactccaagatgccggggtctatcgatgtatgatctcttacggtggcggagcggattataaacggataaccgtcaaggtgaacgccggatccggagggtctgggggaggcggttctgggggtggaggctcaagccagcagatatatggagtagtatatggaaacgtcacttttcatgttcctagtaacgtacctctgaaagaagtactttggaagaagcagaaggataaagtggctgaattggagaatagcgaatttagagctttttcctcattcaaaaatcgggtctatcttgatacggtctcaggctcacttactatttacaatcttacttctagcgacgaggacgagtacgagatggaatctccgaatatcacagacactatgaaattttttttgtacgtccttgagagcggatccggtggaggagggtcagactataaagatgacgacgacaaacaccatcatcaccatcac

SEQ ID NO: 3688 - protein, 484 aa, Artificial sequence
  CD58 3650 - PD-L1 303 - PD-L1 303 - CD58 3650
SQQIYGVVYGNVTFHVPSNVPLKEVLWKKQKDKVAELENSEFRAFSSFKNRVYLDTVSGSLTIYNLTSSDEDEYEMESPNITDTMKFFLYVLESGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGGGGSGGGGSGGGGSFTVTVPKDLYVVEYGSNMTIECKFPVEKQLDLAALIVYWEMEGKDIIQFVHGEEDQKAQHSSYRQRARLLKDQLSLGNAALQITDVKLQDAGVYRCMISYGGGADYKRITVKVNAGSGGSGGGGSGGGGSSQQIYGVVYGNVTFHVPSNVPLKEVLWKKQKDKVAELENSEFRAFSSFKNRVYLDTVSGSLTIYNLTSSDEDEYEMESPNITDTMKFFLYVLESGSGGGGSDYKDDDDKHHHHHH

What is claimed:

1. An immunomodulatory polypeptide comprising, an activating receptor binding molecule (ARBM), wherein the ARBM comprises a variant CTLA-4 polypeptide comprising an L63P amino acid modification, wherein the variant CTLA-4 polypeptide amino acids are numbered with reference to SEQ ID NO: 36; and an inhibitory receptor binding molecule (IRBM), wherein the IRBM comprises a variant PD-L1 polypeptide comprising an N45D amino acid modification, wherein the variant PD-L1 polypeptide amino acids are numbered with reference to SEQ ID NO: 309.

2. The polypeptide of claim 1 comprising (i) the ARBM, (ii) a first peptide linker, (iii) an immunoglobulin Fc region, (iv) a second peptide linker, and (v) the IRBM.

3. The polypeptide of claim 1, wherein the variant PD-L1 polypeptide further comprises one or more amino acid modifications selected from the group consisting of I20L, K28E, D43G, L56Q, V58A, N78I, Q89R, and G101G-ins.

4. The polypeptide of claim 3, wherein the variant PD-L1 polypeptide comprises the amino acid modifications D43G/N45D/L56Q/V58A/G101G-ins, I20L/D43G/N45D/N78I, or I20L/K28E/D43G/N45D/V58A/Q89R/G101G-ins.

5. The polypeptide of claim 3, wherein the variant PD-L1 polypeptide comprises the sequence of SEQ ID NO: 303, 292, or 1727.

6. The polypeptide of claim 1, wherein the variant CTLA-4 polypeptide further comprises one or more amino acid modifications selected from the group consisting of G29W, T53S, M56K, N58S, Q82R, M87V, L98Q, and Y105L.

7. The polypeptide of claim 6, wherein the variant CTLA-4 polypeptide comprises the amino acid modifications G29W/N58S/L63P/Q82R/L98Q/Y105L, T53S/L63P/Y105L, or M56K/N58S/L63P/M87V/L98Q/Y105L.

8. The polypeptide of claim 6, wherein the variant CTLA-4 polypeptide comprises the sequence of SEQ ID NO: 3037, 3591, or 3598.

9. The polypeptide of claim 1, wherein the variant CTLA-4 polypeptide comprises the amino acid modifications G29W/N58S/L63P/Q82R/L98Q/Y105L and the variant PD-L1 polypeptide comprises the amino acid modifications D43G/N45D/L56Q/V58A/G101G-ins.

10. The polypeptide of claim 1, wherein the variant CTLA-4 polypeptide comprises the amino acid modifications G29W/N58S/L63P/Q82R/L98Q/Y105L and the variant PD-L1 polypeptide comprises the amino acid modifications I20L/D43G/N45D/N781.

11. The polypeptide of claim 1, wherein the variant CTLA-4 polypeptide comprises the amino acid modifications G29W/N58S/L63P/Q82R/L98Q/Y105L and the variant PD-L1 polypeptide comprises the amino acid modifications I20L/K28E/D43G/N45D/V58A/Q89R/G101G-ins.

12. The polypeptide of claim 1, wherein the variant CTLA-4 polypeptide comprises the sequence of SEQ ID NO: 3037 and the variant PD-L1 polypeptide comprises the sequence of SEQ ID NO: 303.

13. The polypeptide of claim 1, wherein the variant CTLA-4 polypeptide comprises the sequence of SEQ ID NO: 3037 and the variant PD-L1 polypeptide comprises the sequence of SEQ ID NO: 292.

14. The polypeptide of claim 1, wherein the variant CTLA-4 polypeptide comprises the sequence of SEQ ID NO: 3037 and the variant PD-L1 polypeptide comprises the sequence of SEQ ID NO: 1727.

15. The polypeptide of claim 2, wherein each of the first peptide linker and the second peptide linker is selected from:
(i) $[G_xS_y]_z$, where x is an integer from 1 to 4, y is 0 or 1, and z is an integer from 1 to 50,
(ii) $S(G_4S)_n$, where n is an integer from 1 to 20,
(iii) $(GA)_n$, where n is an integer from 1 to 20,
(iv) $(A)_n$, where n is an integer from 1 to 20,
(v) $(EAAAK)_n$, where n is an integer from 1 to 20,
(vi) GGGGS (SEQ ID NO: 1942), GGGGSGGGGS (2×GGGGS; SEQ ID NO: 240), GGGGSGGGGSGGGGS (3×GGGGS; SEQ ID NO: 239), 4×GGGGS, 5×GGGGS, GSGGS (SEQ ID NO: 2523), GSGGGGS (SEQ ID NO: 1941), GGGGSSA (SEQ ID NO: 2524), GGGGSGGGGSAAA (SEQ ID NO:241), EAAAK (SEQ ID NO: 3240), 3×EAAAK (SEQ ID NO: 3241), 5×EAAAK (SEQ ID NO: 3242), and
(vii) combinations thereof.

16. The polypeptide of claim 2, wherein the Fc region is at least 85% identical to SEQ ID NO: 187.

17. The polypeptide of claim 16, wherein the Fc region comprises one or more modifications selected from the group consisting of C5S, L19A, L20E, G22A, E141D, M143L, and deletion of K232, wherein the Fc region amino acids are numbered with reference to SEQ ID NO: 187.

18. The polypeptide of claim 17, wherein the Fc region comprises the modifications C5S, L19A, L20E, G22A, E141D, M143L and deletion of K232.

19. The polypeptide of claim 18, wherein the Fc region comprises the sequence of SEQ ID NO: 1715.

20. The polypeptide of claim 2, wherein the N-terminal to C-terminal orientation is: the variant CTLA-4 polypeptide, the first peptide linker, the Fc region, the second peptide linker, and the variant PD-L1 polypeptide.

21. The polypeptide of claim 20, wherein the variant CTLA-4 polypeptide comprises the sequence of SEQ ID NO: 3037, the first peptide linker comprises the sequence of SEQ ID NO: 1941, the Fc region comprises the sequence of SEQ ID NO: 1715, the second peptide linker comprises the sequence of SEQ ID NO: 239, and the variant PD-L1 polypeptide comprises the sequence of SEQ ID NO: 303.

22. The polypeptide of claim 20, wherein the variant CTLA-4 polypeptide comprises the sequence of SEQ ID NO: 3037, the first peptide linker comprises the sequence of SEQ ID NO: 1941, the Fc region comprises the sequence of SEQ ID NO: 1715, the second peptide linker comprises the sequence of SEQ ID NO: 239, and the variant PD-L1 polypeptide comprises the sequence of SEQ ID NO: 292.

23. The polypeptide of claim 20, wherein the variant CTLA-4 polypeptide comprises the sequence of SEQ ID NO: 3037, the first peptide linker comprises the sequence of SEQ ID NO: 1941, the Fc region comprises the sequence of SEQ ID NO: 1715, the second peptide linker comprises the sequence of SEQ ID NO: 239, and the variant PD-L1 polypeptide comprises the sequence of SEQ ID NO: 1727.

24. The polypeptide of claim 2, wherein the N-terminal to C-terminal orientation is: the Fc region, the first peptide linker, the variant CTLA-4 polypeptide, the second peptide linker, and the variant PD-L1 polypeptide.

25. The polypeptide of claim 24, wherein the Fc region comprises the sequence of SEQ ID NO: 1715, the first peptide linker comprises the sequence of SEQ ID NO: 239, the variant CTLA-4 polypeptide comprises the sequence of SEQ ID NO: 3037, the second peptide linker comprises the sequence of SEQ ID NO: 239, and the variant PD-L1 polypeptide comprises the sequence of SEQ ID NO: 303, 292, or 1727.

26. A nucleic acid molecule encoding the polypeptide of claim 1.

27. A vector, comprising the nucleic acid molecule of claim 26.

28. The vector of claim 27, wherein the vector is an expression vector.

29. A cell, comprising the nucleic acid of claim 26.

30. A method of producing a polypeptide, comprising introducing the nucleic acid molecule of claim 26 into a host cell under conditions to express the protein in the cell.

31. The method of claim 30, further comprising isolating or purifying the polypeptide from the cell.

32. A pharmaceutical composition, comprising the polypeptide of claim 1 and a pharmaceutically acceptable excipient.

33. An article of manufacture comprising the pharmaceutical composition of claim 32 in a vial or container.

34. A kit comprising the pharmaceutical composition of claim 32 or the article of manufacture of claim 33, and instructions for use.

35. A method of decreasing an immune response in a subject, comprising administering the pharmaceutical composition of claim 32 to the subject.

36. The method of claim 35, wherein decreasing the immune response treats Antineutrophil cytoplasmic antibodies (ANCA)-associated vasculitis, a vasculitis, an autoimmune skin disease, transplantation, a Rheumatic disease, a thyroiditis, an inflammatory gastrointestinal disease, an inflammatory eye disease, an inflammatory neurological disease, an inflammatory pulmonary disease, an inflammatory endocrine disease, an autoimmune hematological disease, an autoimmune demyelinating disease, an autoimmune disease involving a systemic autoimmune disorder, inflammatory bowel disease (IBD), Crohn's disease, ulcerative colitis, asthma, autoimmune asthma, lupus erythematosus, celiac disease, Guillain-Barre syndrome, Chronic Inflammatory Demyelinating Polyneuropathy, Graves' disease, DeQuervains thyroiditis, Vasculitis, autoimmune atrophic gastritis of pernicious anemia, autoimmune encephalomyelitis, autoimmune thrombocytopenia, sympathetic opthalmia, chronic aggressive hepatitis, membranous glomerulopathy, primary idiopathic myxedema, chronic hepatitis, hypogonadism, pernicious anemia, autoimmune enteropathy syndrome, acquired splenic atrophy, idiopathic diabetes insipidus, infertility due to antispermatazoan antibodies, sensoneural hearing loss, transverse myelitis, ataxic sclerosis, *Pemphigus*, progressive systemic sclerosis, polyarteritis nodosa, hemolytic anemia, glomerular nephritis, and idiopathic facial paralysis, giant cell arteritis (GCA), cancer, Addison's Disease, Allergy, Alopecia Areata, Alzheimer's, Ankylosing Spondylitis, Antiphospholipid Syndrome (Hughes Syndrome), Arthritis, Atherosclerosis, Atherosclerotic plaque, autoimmune disease, Autoimmune Hemolytic Anemia, Autoimmune Hepatitis, Autoimmune inner ear disease, Autoimmune Lymphoproliferative syndrome, Autoimmune Myocarditis, Autoimmune Oophoritis, Autoimmune Orchitis, Azoospermia, Behcet's Disease, Berger's Disease, Bullous Pemphigoid, Cardiomyopathy, Cardiovascular disease, Celiac Sprue/Coeliac disease, Chronic Fatigue Immune Dysfunction Syndrome (CFIDS), Chronic idiopathic polyneuritis, Chronic Inflammatory Demyelinating Polyradicalneuropathy (CIPD), Chronic relapsing polyneuropathy (Guillain-Barre syndrome), Churg-Strauss Syndrome (CSS), Cicatricial Pemphigoid, Cold Agglutinin Disease (CAD), COPD, CREST syndrome, Dermatitis, Herpetiformus, Dermatomyositis, diabetes, Discoid Lupus, Eczema, Epidermolysis bullosa acquisita, Essential Mixed Cryoglobulinemia, Evan's Syndrome, Exopthalmos, Fibromyalgia, Goodpasture's Syndrome, graft-related disease or disorder, GVHD, Hashimoto's Thyroiditis, Idiopathic Pulmonary Fibrosis, Idiopathic Thrombocytopenia Purpura (ITP), IgA Nephropathy, immunoproliferative disease or disorder, Insulin Dependent Diabetes Mellitus (IDDM), Interstitial lung disease, juvenile diabetes, Juvenile Arthritis, juvenile idiopathic arthritis (JIA), Kawasaki's Disease, Lambert-Eaton Myasthenic Syndrome, Lichen Planus, Lupus, Lupus Nephritis, Lymphoscytic Lypophisitis, Ménière's Disease, Miller Fish Syndrome/acute disseminated encephalomyeloradiculopathy, Mixed Connective Tissue Disease, Multiple Sclerosis (MS), muscular rheumatism, Myalgic encephalomyelitis (ME), Myasthenia Gravis, Ocular Inflammation, *Pemphigus Foliaceus, Pemphigus Vulgaris*, Pernicious Anaemia, Polychondritis, Polyglandular Syndromes (Whitaker's syndrome), Polymyalgia Rheumatica, Polymyositis, Primary Agammaglobulinemia, Primary Biliary Cirrhosis/Autoimmune cholangiopathy, Psoriasis, Psoriatic arthritis, Raynaud's Phenomenon, Reiter's Syndrome/Reactive arthritis, Restenosis, Rheumatic Fever, rheumatic disease, Rheumatoid Arthritis, Sarcoidosis, Schmidt's syndrome, Scleroderma, Sjörgen's Syndrome, Solid-organ transplant rejection, Stiff-Man Syndrome, Systemic Lupus Erythematosus (SLE), systemic scleroderma, Takayasu Arteritis, Temporal Arteritis/Giant Cell Arteritis, Thyroiditis, Type 1 diabetes, Type 2 diabetes, Uveitis, Vitiligo, Wegener's Granulomatosis, an immune response associated with rejection of a donor tissue, cell, graft, or organ transplant by a recipient subject, graft versus host disease (GVDH), or interstitial bowel disease.

37. The method of claim 35, wherein decreasing the immune response treats an inflammatory or autoimmune disease or condition.

* * * * *

UNITED STATES PATENT AND TRADEMARK OFFICE
CERTIFICATE OF CORRECTION

PATENT NO. : 12,297,253 B2
APPLICATION NO. : 16/959662
DATED : May 13, 2025
INVENTOR(S) : Ryan Swanson It is certified that error appears in the above-identified patent and that said Letters Patent is hereby corrected as shown below:

In the Claims

At Column 331, Line 25, "I20L/D43G/N45D/N781." should be -- I20L/D43G/N45D/N78I. --.

At Column 333, Line 13, "DeQuervains thyroiditis," should be -- De Quervain's thyroiditis, --.

At Column 333, Lines 15-16, "opthalmia" should be -- ophthalmia, --.

At Column 333, Line 21, "sensoneural" should be -- sensorineural --.

At Column 333, Line 37, "Polyradicalneuropathy" should be -- Polyradiculoneuropathy --.

At Column 333, Line 38, "(Guillain-Barre syndrome)," should be -- (Guillain-Barré syndrome), --.

At Column 334, Line 2, "Herpetiformus," should be -- Herpetiformis, --.

At Column 334, Line 2, "diabetes," should be -- Diabetes, --.

At Column 334, Line 4, "Exopthalmos," should be -- Exophthalmos, --.

At Column 334, Line 13, "Lymphoscytic Lypophisitis," should be -- Lymphocytic Hypophysitis, --.

At Column 334, Line 26, "Sjörgen's Syndrome," should be -- Sjögren's Syndrome, --.

Signed and Sealed this
Twenty-fifth Day of November, 2025

John A. Squires
*Director of the United States Patent and Trademark Office*